United States Patent
Springer et al.

(10) Patent No.: US 10,273,283 B2
(45) Date of Patent: Apr. 30, 2019

(54) MODIFIED INTEGRIN POLYPEPTIDES, MODIFIED INTEGRIN POLYPEPTIDE DIMERS, AND USES THEREOF

(71) Applicant: THE CHILDREN'S MEDICAL CENTER CORPORATION, Boston, MA (US)

(72) Inventors: Timothy Alan Springer, Newton, MA (US); Xianchi Dong, Malden, MA (US); Chafen Lu, Newton, MA (US)

(73) Assignee: The Children's Medical Center Corporation, Boston, MA (US)

( * ) Notice: Subject to any disclaimer, the term of this patent is extended or adjusted under 35 U.S.C. 154(b) by 0 days.

(21) Appl. No.: 15/424,260

(22) Filed: Feb. 3, 2017

(65) Prior Publication Data

US 2017/0183390 A1 Jun. 29, 2017

Related U.S. Application Data

(63) Continuation-in-part of application No. PCT/US2015/044093, filed on Aug. 6, 2015.

(60) Provisional application No. 62/033,699, filed on Aug. 6, 2014.

(51) Int. Cl.
| | |
|---|---|
| *A61K 38/17* | (2006.01) |
| *C07K 14/705* | (2006.01) |
| *G01N 33/68* | (2006.01) |
| *G06F 19/00* | (2018.01) |

(52) U.S. Cl.
CPC .... *C07K 14/70546* (2013.01); *A61K 38/1777* (2013.01); *G01N 33/6872* (2013.01); *G06F 19/701* (2013.01); *C07K 2299/00* (2013.01); *C07K 2319/00* (2013.01)

(58) Field of Classification Search
None
See application file for complete search history.

(56) References Cited

U.S. PATENT DOCUMENTS

| | | |
|---|---|---|
| 2010/0167418 A1 | 7/2010 | Springer et al. |
| 2013/0072433 A1 | 3/2013 | Du |
| 2014/0044646 A1 | 2/2014 | Li et al. |

FOREIGN PATENT DOCUMENTS

WO 2004/007530 A2 1/2004

OTHER PUBLICATIONS

Takagi et al. "Changing ligand specificities of αvβ1 and αvβ3 integrins by swapping a short diverse sequence of the β subunit." Journal of Biological Chemistry 272(32):19794-19800 (1997).
Wang et al., "GARP regulates the bioavailability and activation of TGFβ." Molecular Biology of the Cell 23(6):1129-1139 (2012).
Xiong et al., "Crystal structure of the complete integrin αVβ3 ectodomain plus an α/β transmembrane fragment." The Journal of Cell Biology 186(4):589-600 (2009).
Dong et al., "α(V)β(3) integrin crystal structures and their functional implications", Biochemistry, 51(44):8814-28 (2012).
Hayashido et al., "Overexpression of integrin αv facilitates proliferation and invasion of oral squamous cell carcinoma cells via MEK/ERK signaling pathway that is activated by interaction of integrin αvβ8 with type I collagen", Int J Oncol, 45(5):1875-82 (2014).

*Primary Examiner* — Fred H Reynolds
(74) *Attorney, Agent, or Firm* — Nixon Peabody LLP

(57) ABSTRACT

Described herein are modified integrin α and/or β headpiece polypeptides, and crystallizable integrin polypeptide dimers comprising a modified integrin α and/or β headpiece polypeptide and a disulfide bond linking the two integrin headpiece polypeptide subunits. Methods for using the modified integrin α and/or β headpiece polypeptides and the integrin polypeptide dimers are also provided herein. For example, methods for characterizing integrin-ligand interaction and identifying integrin ligands are also provided herein. In some embodiments, the identified integrin ligands can be used as inhibitors of integrins.

16 Claims, 21 Drawing Sheets

Specification includes a Sequence Listing.

TGF-β1 GRRGDLATIHG
TGF-β2 YTSGDQKTIKS
TGF-β3 HGRGDLGRLKK
FMDV  NLRGDLQVLAQ

| Sequence | K_D (nM) |
|---|---|
| ●— HGRGDLGRLKK | 7.3 (6.3-8.5) |
| ■— HGRGDLGRLK | 20.3 (16.9-24.3) |
| ▲— HGRGDLGRL | 28.4 (23.7-34.0) |
| ▼— HGRGDLGR | 296 (247-354) |
| ♦— HGRGDLG | 691 (577-827) |
| ○— HGRGDL | 966 (807-1160) |
| □— HGRGD | 8900 (7220-11000) |

Signal sequence

PSI domain

1   MCGSALAFFT AAFVCLQNDR RGPASFLMAA WVFSLVLGLG QGEDNRCASS NAASCARCLA
61  LGPECGWCVQ EDFISGGSRS ERCDIVSNLI SKGCSVDSIE YPSVHVIIPT ENEINIQVTP ←Hybrid domain
121 GEVSIQIRPG AEANFMLKVH PLKK YPVDLY YLVDVSASMH NNIEKLNSVG NDLSRKMAFF
181 SRDFRLGFGS YVDKTVSPYI SIHPERIHNQ CSDYNLDCMP PHGYIHVLSL TENITEFEKA ←β1 domain
241 VHRQKISGNI DTPEGGFDAM LQAAVCESHI GWRKEAKRLL LVMTDQTSHL ALDSKLAGIV
301 VPNDGNCHLK NNVYVKSTTM EHPSLGQLSE KLIDNNINVI FAVQGKQFHW YKDLLPLLPG
361 TIAGETESKA ANLNNLVVEA YQKLISEVKV QVENQVQGIY FNITAICPDG SRKPGMEGCR ←Hybrid domain
421 NVTSNDEVLF NVTVTMKKCD VTGGKNYALI KPIGFNETAK IHIHRNCSCQ CEDNRGPKGK ←EGF-1 domain
481 CVDETFLDSK CFQCDENKCH FDEDQFSSES CKSHKDQPVC SGRGVCVCGK CSCHKIKLGK
541 VYGKYCEKDD FSCPYHHGNL CAGHGECEAG RCQCESGWEG DRCQCPSAAA QHCVNSKGQV
601 CSGRGTCVCG RCECTDPRSI GRFCEHCPTC YTACKENWNC MQCLHPHNLS QAILDQCKTS
661 CALMEQQHYV DQTSECFSSP SYLRIFFIIF IVTFLIGLLK VLIIRQVILQ WNSNKIKSSS
721 DYRVSASKKD KLILQSVCTR AVTYRREKPE EIKMDISKLN AHETFRCNF (SEQ ID NO: 6)

*FIG. 10*

MODIFIED INTEGRIN POLYPEPTIDES, MODIFIED INTEGRIN POLYPEPTIDE DIMERS, AND USES THEREOF

CROSS-REFERENCE TO RELATED APPLICATIONS

This Application is a continuation-in-part application of PCT Application No: PCT/US15/44093 filed Aug. 6, 2015, which claims benefit under 35 U.S.C. § 119(e) of the U.S. Provisional Application No. 62/033,699 filed Aug. 6, 2014, the contents of which are incorporated herein by reference in their entirety.

SEQUENCE LISTING

The instant application contains a Sequence Listing which has been submitted electronically in ASCII format and is hereby incorporated by reference in its entirety. Said ASCII copy, created on Feb. 3, 2017, is named 701039-080812-CIP.txt and is 869,592 bytes in size.

TECHNICAL FIELD

The present invention relates to modified integrin polypeptides, crystallizable dimers comprising a modified integrin polypeptide, and methods of using the same. Methods for characterizing integrin-ligand interaction and identifying integrin ligands are also provided herein. The identified integrin ligands can be used as inhibitors of integrins.

BACKGROUND

Integrins are $\alpha/\beta$ heterodimers and act as cell surface receptors that mediate cell to cell, or cell to extracellular matrix adhesion. Integrins connect diverse extracellular ligands to the cytoskeleton and regulate cell growth and differentiation. Hynes (2002) Cell 110: 673. The primary function of most of the twenty-four vertebrate integrins is to mediate cell adhesion and migration; in contrast, integrins $\alpha_v\beta_6$ and $\beta_v\beta_8$ are specialized to activate TGF-$\beta$1 and $\beta$3. Munger et al. (1999) Cell 96: 319; and Mu et al. (2002) J. Cell Biol. 157: 493. The similarity in phenotypes of mice deficient in TGF-$\beta$1 (Shull et al. (1992) Nature 359: 693), integrin $\alpha_v\beta_6$ (Munger et al. (1999) Cell 96: 319) and $\alpha_v\beta_8$ (Mu et al. (2002) J. Cell Biol. 157: 493), and mice in which RGE in pro-TGF-$\beta$1 replaces RGD (Yang et al. (2007) J. Cell Biol. 176: 787), shows the importance of the RGD motif and integrins $\alpha_v\beta_6$ and $\alpha_v\beta_8$ in TGF-$\beta$1 activation in vivo. How integrins $\alpha_v\beta_6$ and $\alpha_v\beta_8$ achieve specificity, and how integrin $\beta$-subunits in general contribute to ligand specificity remains unclear. Little is known beyond mutational evidence for the importance of a disulfide-bonded loop (the $\beta$2-$\beta$3 loop) in the $\beta$I domain (Takagi et al. (1997) J. Biol. Chem. 272: 19794), and invariant binding of the metal ion dependent adhesion site (MIDAS) to an acidic residue present in all integrin ligands (Xiong et al. (2002) Science 296: 151; Xiao et al. (2004) Nature 432: 59; Nagae et al. (2012) J. Cell Biol. 197: 131; and Sen et al. (2013) J. Cell Biol. 203: 629). The issue of how the $\beta$-subunit contributes specificity is particularly acute for the five RGD-recognizing integrins that contain the acv subunit and only differ in having the $\beta_1$, $\beta_3$, $\beta_5$, $\beta_6$, or $\beta_8$ subunit.

Further, integrins represent a target for treatment of various diseases or disorders, including, e.g., inflammatory diseases, anti-angiogenic therapy, and anti-thrombotic therapy, among others. Thus, screening for and identifying new small molecules that bind to the integrin ligand binding site and block interaction with its natural ligand can facilitate drug discovery process.

However, the fact that functional integrins are dimeric molecules makes study and screening of molecules that affect their function and interactions challenging. Therefore, there remains a need for methods to facilitate methods and assays for screening and characterizing integrin-ligand interaction, and thus identifying integrin ligands, e.g., for therapeutic treatment.

SUMMARY

Integrins are generally non-covalently linked heterodimers of $\alpha$ and $\beta$ subunits. Thus, the integrin heterodimers can reversibly dissociate, which in turn makes the process of characterizing an integrin-binding interaction and/or identifying a ligand that binds to the integrin heterodimer more difficult or the outcomes less reliable. The inventors have identified modifications that allow covalent linking of integrins thus allowing a more reliable use of them in drug screening assays.

Embodiments of various aspects described herein are, at least in part, based on development of cross-linkable integrin $\alpha$ and $\beta$ polypeptide subunits, which can form covalently-linked $\alpha/\beta$ heterdimers through at least one disulfide bond, but the function of which closely mimics or is identical to naturally occurring integrin dimers. These covalently linked heterodimers allow the inventors also to provide assays and methods for screening for agents, including small molecules, peptides and other kinds of molecules, for their potential to alter the function of integrins.

The inventors modified the integrin $\alpha$ and $\beta$ polypeptide subunits, for example, by introducing at least one cysteine residue into an integrin $\alpha$ headpiece polypeptide and an integrin $\beta$ headpiece polypeptide. For example, the inventors have modified integrin $\alpha_v$ headpiece and $\beta_6$ headpiece polypeptides to introduce a disulfide bond that can covalently link the two headpiece polypeptides together.

Based on the crystal structure of integrin $\alpha_v\beta_6$ heterodimer, the inventors chose to modify residues in domain(s) that are distal from the ligand-binding sites, e.g., residue(s) in the $\alpha_v$ subunit $\beta$-propeller domain and in the $\beta_6$ subunit $\beta$I domain. These sites were modified to introduce a cysteine substitution. They discovered that the resulting dimers were surprisingly stable but also retained the functionality of the natural integrins. The inventors further added an extra glycine residue into the integrin $\alpha_v$ headpiece polypeptide at specific locations. This modification surprisingly further improved crystallization and/or expression of an integrin $\alpha_v\beta_6$ heterodimer upon binding with a test agent. Thus, the inventors showed that covalently-linked integrin dimers, such as the covalently-linked integrin $\alpha_v\beta_6$ heterodimers, can be used to facilitate discovery of novel ligands for integrin heterodimers, such as $\alpha_v\beta_6$ heterodimers.

Further, based on the covalently-linked integrin heterodimer, such as $\alpha_v\beta_6$ headpiece heterodimer, the inventors identified a novel hydrophobic binding pocket which is a novel target site for these integrin headpieces. This particular hydrophobic pocket can be used not only in vitro, but also in silico for facilitating discovery of potent ligands or inhibitors that can modify, i.e., agonize or antagonize, natural integrin heterodimer function.

In addition, the inventors have introduced cysteine(s) in the integrin $\beta_3$ and $\beta_8$ subunits at the same position structurally as in the integrin $\beta_6$ subunits, and thus generated covalently-linked integrin $\alpha_v\beta_3$ and $\alpha_v\beta_8$ heterodimers, which can be crystallized to form crystal structures with a much higher resolution (e.g., less than 3 Å or less than 2 Å or less than 1 Å).

Generally, a full integrin headpiece dimer is a 6-domain structure, as a wild-type integrin α headpiece polypeptide includes β-propeller domain and a thigh domain, while a wild-type integrin β headpiece polypeptide includes a βI domain, a hybrid domain, a PSI (plexin, semaphoring, and integrin) domain, and an I-EGF-1 domain. Here, the inventors have surprisingly discovered that a 3-domain integrin fragment of the αβ headpiece dimer, which contains only the α β-propeller and thigh domains and the β βI domain, and is crosslinked using a disulfide bond as described herein, can be generated with good expression. In one embodiment, the inventors have created a functional 3-domain disulfide-linked integrin fragment of the $\alpha_v\beta_6$ headpiece dimer that is capable of binding a ligand as the corresponding full headpiece. Such an integrin fragment has never been previously made in good yield, but the inventors was successfully able to express such a 3-domain integrin fragment by introducing a disulfide bond to crosslink the α headpiece fragment and the β headpiece fragment. Thus, not only have the inventors generated disulfide-linked full headpiece of integrin dimers, but they have also successfully generated functional fragments of integrin headpiece dimers (e.g., 3-domain structure) that can bind a ligand as the corresponding full headpiece dimer. Accordingly, fragments of modified polypeptide dimers, e.g., 3-domain structure, 4-domain structure, and 5-domain structure, are also described herein. The multi-domain structures can be formed from any combination of the 6 domains derived from the integrin α and β headpieces. In some embodiments, the 3-domain integrin polypeptide dimer can comprise, essentially consist of, or consist of a β-propeller domain and a thigh domain of a modified integrin α headpiece incorporated with at least one or more cysteine substitutions as described herein (e.g., modified integrin $\alpha_v$ headpiece polypeptide described herein), and a βI domain of a modified integrin β headpiece incorporated with at least one or more cysteine substitutions as described herein (e.g., modified integrin $\beta_6$ headpiece polypeptide described herein). In some embodiments, the 4-domain integrin polypeptide dimer can comprise, essentially consist of, or consist of a β-propeller domain and a thigh domain of a modified integrin α headpiece incorporated with at least one or more cysteine substitutions as described herein (e.g., modified integrin $\alpha_v$ headpiece polypeptide described herein), and a βI domain and a hybrid domain of a modified integrin β headpiece incorporated with at least one or more cysteine substitutions as described herein (e.g., modified integrin $\beta_6$ headpiece polypeptide described herein). In some embodiments, the 5-domain integrin polypeptide dimer can comprise, essentially consist of, or consist of a β-propeller domain and a thigh domain of a modified integrin α headpiece incorporated with at least one or more cysteine substitutions as described herein (e.g., modified integrin $\alpha_v$ headpiece polypeptide described herein), and a βI domain, a hybrid domain, and a PSI domain of a modified integrin β headpiece incorporated with at least one or more cysteine substitutions as described herein (e.g., modified integrin $\beta_6$ headpiece polypeptide described herein).

Accordingly, various aspects described herein provide for novel compositions, e.g., modified integrin headpiece polypeptides, and crystallizable integrin polypeptide dimers comprising at least one modified integrin headpiece polypeptide, and methods of using the same. In some embodiments, the methods described herein comprise using one or more of the compositions described herein to characterize an integrin dimer-ligand interaction and/or to identify whether a test agent forms a complex with the integrin dimer. In some embodiments, the methods described herein comprise using one or more of the compositions described herein to determine binding affinity of a test agent to an integrin dimer. Methods for identifying a ligand, such as an inhibitor or an agonist, that bind to integrin heterodimers, such as $\alpha_v\beta_6$ heterodimer are also provided herein.

In one aspect, provided herein is a modified integrin $\alpha_v$ headpiece polypeptide. The modified integrin $\alpha_v$ headpiece polypeptide comprises, consists essentially of, or consists of an amino acid sequence of an integrin $\alpha_v$ headpiece polypeptide (SEQ ID NO: 1) or a functional variant thereof, with at least one Cys residue introduced thereto by one or more (e.g., at least one, at least two or more) of the following modifications (a)-(e):

a. substitution of amino acid residues 399-401 (Ser-Met-Pro) with one of the following: (i) Ser-Cys-Pro; (ii) Gly-Cys-Pro; (iii) Ser-Cys-Gly; (iv) Gly-Cys-Gly; (v) Ser-Gly-Cys-Pro (SEQ ID NO: 59); (vi) Ser-Cys-Gly-Pro (SEQ ID NO: 60); (vii) Gly-Cys-Gly-Pro (SEQ ID NO: 61); and (viii) Ser-Gly-Cys-Gly (SEQ ID NO: 62).
b. substitution of amino acid residues 310-311 (Gln-Glu) with Gly-Cys;
c. substitution of amino acid residues 299 (Leu) and 310 (Gln) with Cys and Gly, respectively;
d. substitution of amino acid residues 302-311 (Asp-Arg-Gly-Ser-Asp-Gly-Lys-Leu-Gln-Glu) (SEQ ID NO: 63) with Gly-Gln-Gly-Cys (SEQ ID NO: 64); and
e. substitution of amino acid residue 299 (Leu) to Cys and substitution of amino acid residues 302-310 (Asp-Arg-Gly-Ser-Asp-Gly-Lys-Leu-Gln) (SEQ ID NO: 65) with Gly-Gln-Gly.

The modified integrin $\alpha_v$ headpiece polypeptide can be isolated. The modified integrin $\alpha_v$ headpiece polypeptide can further be attached to a solid surface.

In some embodiments, the modified integrin $\alpha_v$ headpiece polypeptide can comprise, consist essentially of, or consist of an amino acid sequence of an integrin $\alpha_v$ headpiece polypeptide (SEQ ID NO:1) or a functional variant thereof, with at least one Cys residue introduced thereto by substitution of amino acid residues 399-401 (Ser-Met-Pro) with Ser-Cys-Pro (modification (a)(i)). In some embodiments, the modified integrin $\alpha_v$ headpiece polypeptide can comprise, consist essentially of, or consist of an amino acid sequence of an integrin $\alpha_v$ headpiece polypeptide (SEQ ID NO: 1) or a functional variant thereof, with at least one Cys residue introduced thereto by substitution of amino acid residues 399-401 (Ser-Met-Pro) with Gly-Cys-Pro (modification (a)(ii)). In some embodiments, the modified integrin $\alpha_v$ headpiece polypeptide can comprise, consist essentially of, or consist of an amino acid sequence of an integrin $\alpha_v$ headpiece polypeptide (SEQ ID NO: 1) or a functional variant thereof, with at least one Cys residue introduced thereto by substitution of amino acid residues 399-401 (Ser-Met-Pro) with Ser-Gly-Cys-Pro (SEQ ID NO: 59) (modification (a)(v)).

In some embodiments, the modified integrin $\alpha_v$ headpiece polypeptide can comprise, consist essentially of, or consist of an amino acid sequence of an integrin $\alpha_v$ headpiece polypeptide (SEQ ID NO: 1) or a functional variant thereof, with at least two Cys residues introduced thereto by at least two or more of the modifications (a)-(e) as described above. By way of example only, in some embodiments, at least two Cys residues can be introduced into the modified integrin $\alpha_v$ headpiece polypeptide by (1) one of the modifications (a)

(i)-(viii) as described above; and (2) at least one of the modifications (b)-(e) as described above.

In some embodiments, the modified integrin $\alpha_v$ headpiece polypeptide described herein is a soluble polypeptide.

In another aspect, provided herein is a modified integrin $\beta_6$ headpiece polypeptide. The integrin $\beta_6$ headpiece polypeptide comprises, consists essentially of, or consist of an amino acid sequence of an integrin $\beta_6$ headpiece polypeptide (SEQ ID NO: 2) or a functional variant thereof, with at least one Cys residue introduced thereto by one, two, or all three of the following modifications (f)-(h):
  f. substitution of amino acid residue 270 (Ile) with Cys;
  g. substitution of amino acid residue 294 (Thr) with Cys; and
  h. substitution of amino acid residue 296 (Gly) with Cys.

The modified integrin $\beta_6$ headpiece polypeptide can be isolated. The modified integrin $\beta_6$ headpiece polypeptide can further be attached to a solid surface.

In some embodiments, the modified integrin $\beta_6$ headpiece polypeptide can comprise, consist essentially of, or consist of an amino acid sequence of an integrin $\beta_6$ headpiece polypeptide (SEQ ID NO: 2) or a functional variant thereof, with at least one Cys residue introduced thereto by substitution of amino acid residue 270 (Ile) with Cys (modification (f)).

In some embodiments, the modified integrin $\beta_6$ headpiece polypeptide can comprise, consist essentially of, or consist of an amino acid sequence of an integrin $\beta_6$ headpiece polypeptide (SEQ ID NO: 2) or a functional variant thereof, with at least two Cys residues introduced thereto by at least two or more of the modifications (f)-(h) as described above. By way of example only, in some embodiments, at least two Cys residues can be introduced into the modified integrin $\beta_6$ headpiece polypeptide by any two of the modifications (f)-(h) as described above.

In some embodiments, the modified integrin $\beta_6$ headpiece polypeptide described herein is a soluble polypeptide.

In some aspects, provided herein are fragments of the modified integrin 136 headpiece polypeptides described herein. In one aspect, the integrin $\beta_6$ headpiece polypeptide fragment comprises, consists essentially of, or consists of a βI domain of integrin $\beta_6$ subunit with at least one Cys residue introduced thereto by one, two, or all of the following modifications (f)-(h), the βI domain is defined from residues DYP to residues ELR as shown in an amino acid sequence of SEQ ID NO: 2, or a functional variant thereof.
  f. substitution of amino acid residue 270 (Ile) with Cys;
  g. substitution of amino acid residue 294 (Thr) with Cys; and
  h. substitution of amino acid residue 296 (Gly) with Cys.

In another aspect, the integrin $\beta_6$ headpiece polypeptide fragment comprises, consists essentially of, or consists of a βI domain and a hybrid domain of integrin $\beta_6$ subunit, the βI domain being defined from residues DYP to residues ELR as shown in an amino acid sequence of SEQ ID NO: 2, or a functional variant thereof, while the hybrid domain being defined from residues ENP to residues QTE, and/or from residues SEV to residues ECN as shown in an amino acid sequence of SEQ ID NO: 2, or a functional variant thereof; wherein at least one least one Cys residue is introduced to the βI domain by one, two, or all of the following modifications (f)-(h):
  f. substitution of amino acid residue 270 (Ile) with Cys;
  g. substitution of amino acid residue 294 (Thr) with Cys; and
  h. substitution of amino acid residue 296 (Gly) with Cys.

In yet another aspect, the integrin $\beta_6$ headpiece polypeptide fragment comprises, consists essentially of, or consists of a βI domain, a hybrid domain, and a PSI domain of integrin $\beta_6$ subunit, the βI domain being defined from residues DYP to residues ELR as shown in an amino acid sequence of SEQ ID NO: 2, or a functional variant thereof, while the hybrid domain being defined from residues ENP to residues QTE, and/or from residues SEV to residues ECN as shown in an amino acid sequence of SEQ ID NO: 2, or a functional variant thereof; and the PSI domain being defined from from residues HVQ to residues NFI as shown in an amino acid sequence of SEQ ID NO: 2; wherein at least one least one Cys residue is introduced to the βI domain by one, two, or all of the following modifications (f)-(h):
  f. substitution of amino acid residue 270 (Ile) with Cys;
  g. substitution of amino acid residue 294 (Thr) with Cys; and
  h. substitution of amino acid residue 296 (Gly) with Cys.

The modified integrin $\beta_6$ headpiece polypeptide fragments of various aspects described herein can be isolated. The modified integrin $\beta_6$ headpiece polypeptide fragments of various aspects described herein can further be attached to a solid surface.

In some embodiments, the modified integrin $\beta_6$ headpiece polypeptide fragments of various aspects described herein are soluble polypeptides.

In another aspect, provided herein is a modified integrin $\beta_3$ headpiece polypeptide. The integrin $\beta_3$ headpiece polypeptide comprises, essentially consist of, or consist of amino acid residues 27 to 498 of SEQ ID NO: 5 or a functional fragment thereof (e.g., with desired domain(s)) with at least one Cys residue introduced thereto by substitution of amino acid residue 293 (Gin) with Cys. The modified integrin $\beta_3$ headpiece polypeptide can be isolated. The modified integrin $\beta_3$ headpiece polypeptide can further be attached to a solid surface.

In another aspect, provided herein is a modified integrin $\beta_8$ headpiece polypeptide. The integrin $\beta_8$ headpiece polypeptide comprises, essentially consist of, or consist of amino acid residues 43 to 498 of SEQ ID NO: 6 or a functional fragment thereof (e.g., with desired domain(s)) with at least one Cys residue introduced thereto by substitution of amino acid residue 301 (Val) with Cys. The modified integrin 138 headpiece polypeptide can be isolated. The modified integrin $\beta_8$ headpiece polypeptide can further be attached to a solid surface.

The inventors have also introduced at least one disulfide bond to integrin heterodimers, including, but not limited to integrin $\alpha_v\beta_6$ headpiece heterodimer, integrin $\alpha_5\beta_1$ headpiece heterodimer, integrin $\alpha_v\beta_3$ headpiece heterodimer, and integrin $\alpha_v\beta_8$ headpiece heterodimer. Thus, modified integrin headpiece polypeptide dimers comprising at least one of the modified integrin α headpiece polypeptide and the modified integrin β headpiece polypeptide are also provided herein. In accordance with some aspects described herein, the modified integrin polypeptide dimers comprise at least one or more (e.g., at least one, at least two, at least three or more) disulfide bonds linking the two integrin α and β headpiece polypeptides or functional fragments thereof. The modified integrin polypeptide dimer can be isolated or purified. The modified integrin polypeptide dimer can further be attached to a solid surface.

One aspect of the modified integrin polypeptide dimers provided herein relates to a modified integrin polypeptide dimer comprising, consisting essentially of, or consisting of a modified integrin α headpiece polypeptide described herein, and an integrin β polypeptide comprising, consisting essentially of, or consisting of a headpiece of the integrin subunit, wherein the modified integrin α headpiece polypeptide and the integrin β polypeptide are covalently linked by at least one (e.g., at least one, at least two, at least three or more) disulfide bonds. Generally, the integrin α polypeptide can comprise, essentially of, or consist of a β-propeller domain and a thigh domain. In some embodiments, the integrin β polypeptide can comprise, essentially consist of, or consist of a βI domain. In some embodiments, the integrin β polypeptide can comprise, essentially consist of, or consist of a βI domain and a hybrid domain. In some embodiments, the integrin β polypeptide can comprise, essentially consist of, or consist of a βI domain, a hybrid domain, and a PSI domain.

The modified integrin α headpiece polypeptide comprises, consists essentially of, or consists of an amino acid sequence of an integrin α headpiece polypeptide (for example, one of the integrin α headpiece polypeptides selected from the group consisting of $\alpha_1$, $\alpha_2$, $\alpha_3$, $\alpha_4$, $\alpha_5$, $\alpha_6$, $\alpha_7$, $\alpha_8$, $\alpha_9$, $\alpha_{10}$, $\alpha_{11}$, $\alpha_D$, $\alpha_E$, $\alpha_L$, $\alpha_M$, $\alpha_\nu$, $\alpha_{2B}$, and $\alpha_X$) or a functional variant thereof, with at least one or more (e.g., at least one, at least two or more) Cys residues introduced thereto.

In some embodiments, the modified integrin α headpiece polypeptide is a modified integrin $\alpha_\nu$ headpiece polypeptide described herein. In some embodiments, the modified integrin $\alpha_\nu$ headpiece polypeptide can comprise, consist essentially of, or consist of a substitution of amino acid residues 399-401 (Ser-Met-Pro) with Ser-Cys-Pro (modification (a) (i)). In some embodiments, the modified integrin $\alpha_\nu$ headpiece polypeptide can comprise, consist essentially of, or consist of a substitution of amino acid residues 399-401 (Ser-Met-Pro) with Gly-Cys-Pro (modification (a) (ii)). In some embodiments, the modified integrin $\alpha_\nu$ headpiece polypeptide can comprise, consist essentially of, or consist of a substitution of amino acid residues 399-401 (Ser-Met-Pro) with Ser-Gly-Cys-Pro (SEQ ID NO: 59) (modification (a) (v)).

In various embodiments, the integrin β polypeptide (comprising, consisting essentially of, or consisting of a headpiece of the integrin subunit) covalently linked to a modified integrin α headpiece polypeptide described herein (e.g., a modified integrin $\alpha_\nu$ headpiece polypeptide described herein) can be selected from the group consisting of $\beta_1$, $\beta_2$, $\beta_3$, $\beta_4$, $\beta_5$, $\beta_6$, $\beta_7$, and $\beta_8$.

Another aspect of the modified integrin polypeptide dimers provided herein relates to a modified integrin polypeptide dimer comprising, consisting essentially of, or consisting of an integrin α polypeptide (comprising, consisting essentially of, or consisting of a headpiece of the integrin subunit), and a modified integrin β headpiece polypeptide or a modified integrin β headpiece polypeptide fragment described herein, wherein the integrin α polypeptide and the modified integrin β headpiece polypeptide or the modified integrin β headpiece polypeptide fragment are covalently linked by at least one (e.g., at least one, at least two, at least three or more) disulfide bonds.

The modified integrin β headpiece polypeptide comprises, consists essentially of, or consists of an amino acid sequence of an integrin β headpiece polypeptide (for example, one of the integrin β headpiece polypeptides selected from the group consisting of $\beta_1$, $\beta_2$, $\beta_3$, $\beta_4$, $\beta_5$, $\beta_6$, $\beta_7$, and $\beta_8$) or a functional variant thereof, with at least one or more (e.g., at least one, at least two or more) Cys residues introduced thereto.

In some embodiments, the modified integrin β headpiece polypeptide is a modified integrin $\beta_6$ headpiece polypeptide described herein or a functional variant thereof (e.g., a βI domain alone, or in combination with a hybrid domain and/or a PSI domain). In some embodiments, the modified integrin $\beta_6$ headpiece polypeptide or a functional variant thereof can comprise, consist essentially of, or consist of a substitution of amino acid residue 270 (Ile) with Cys (modification (f)). It should be noted that numbering is based on SEQ ID NO: 2, which is the amino acid sequence of the $\beta_6$ full headpiece. One of skill in the art can adjust the numbering of the corresponding cysteine substitution, e.g., when only a βI domain is used.

In some embodiments, the modified integrin β headpiece polypeptide is a modified integrin $\beta_3$ headpiece polypeptide described herein or a functional variant thereof (e.g., a βI domain alone, or in combination with a hybrid domain and/or a PSI domain). In some embodiments, the modified integrin $\beta_3$ headpiece polypeptide or a functional variant thereof can comprise, consist essentially of, or consist of a substitution of amino acid residue 293 (Gln) with Cys. It should be noted that numbering is based on SEQ ID NO: 5, which is the amino acid sequence of the $\beta_3$ full headpiece. One of skill in the art can adjust the numbering of the corresponding cysteine substitution, e.g., when only a βI domain is used.

In some embodiments, the modified integrin β headpiece polypeptide is a modified integrin $\beta_8$ headpiece polypeptide described herein or a functional variant thereof (e.g., a βI domain alone, or in combination with a hybrid domain and/or a PSI domain). In some embodiments, the modified integrin $\beta_8$ headpiece polypeptide or a functional variant thereof can comprise, consist essentially of, or consist of a substitution of amino acid residue 301 (Val) with Cys. It should be noted that numbering is based on SEQ ID NO: 6, which is the amino acid sequence of the $\beta_8$ full headpiece. One of skill in the art can adjust the numbering of the corresponding cysteine substitution, e.g., when only a βI domain is used.

In some embodiments, the integrin α polypeptide covalently linked to the modified integrin β headpiece polypeptide (e.g., a modified integrin $\beta_6$ headpiece polypeptide) can be selected from the group consisting of $\alpha_1$, $\alpha_2$, $\alpha_3$, $\alpha_4$, $\alpha_5$, $\alpha_6$, $\alpha_7$, $\alpha_8$, $\alpha_9$, $\alpha_{10}$, $\alpha_{11}$, $\alpha_D$, $\alpha_E$, $\alpha_L$, $\alpha_M$, $\alpha_\nu$, $\alpha_{2B}$, and $\alpha_X$. In one embodiment, the integrin α polypeptide covalently linked to the modified integrin $\beta_6$ headpiece polypeptide is an integrin $\alpha_\nu$ polypeptide comprising, consisting essentially of, or consisting of the integrin subunit.

A further aspect of the modified integrin polypeptide dimers provided herein relates to a modified integrin polypeptide dimer comprising, consisting essentially of, or consisting of a modified integrin α headpiece polypeptide described herein or a functional variant thereof, and a modified integrin β headpiece polypeptide described herein or a functional variant thereof, wherein the modified integrin α headpiece polypeptide or a functional variant thereof and the modified integrin β headpiece polypeptide or a functional thereof are covalently linked by at least one (e.g., at least one, at least two, at least three or more) disulfide bonds.

The modified integrin α headpiece polypeptide or a functional variant thereof comprises, consists essentially of, or consists of an amino acid sequence of an integrin α headpiece polypeptide (for example, one of the integrin α headpiece polypeptides selected from the group consisting of $\alpha_1$, $\alpha_2$, $\alpha_3$, $\alpha_4$, $\alpha_5$, $\alpha_6$, $\alpha_7$, $\alpha_8$, $\alpha_9$, $\alpha_{10}$, $\alpha_{11}$, $\alpha_D$, $\alpha_E$, $\alpha_L$, $\alpha_M$, $\alpha_\nu$, $\alpha_{2B}$, and $\alpha_X$) or a functional variant thereof, with at least one or more (e.g., at least one, at least two or more) Cys residues introduced thereto; while the modified integrin β headpiece polypeptide comprises, consists essentially of, or consists of an amino acid sequence of an integrin β headpiece polypeptide (for example, one of the integrin β headpiece polypeptides selected from the group consisting of $β_1$, $β_2$, $β_3$, $β_4$, $β_5$, $β_6$, $β_7$, and $β_8$) or a functional variant thereof, with at least one or more (e.g., at least one, at least two or more) Cys residues introduced thereto.

In one aspect, provided herein is a modified integrin polypeptide dimer comprising, consisting essentially of, or consisting of a modified integrin $α_5$ headpiece polypeptide and a modified integrin $β_1$ headpiece polypeptide covalently linked together by at least one or more disulfide bond. In one embodiment, the modified integrin $α_5$ headpiece polypeptide comprises, consists essentially of, or consists of an amino acid sequence of an integrin $α_5$ headpiece polypeptide (e.g., SEQ ID NO: 3) with at least one Cys residue introduced thereby by substitution of amino acid residue 452 (Thr) with Cys. (SEQ ID NO: 3 includes the signal peptide sequence at positions 1-41.) In one embodiment, the modified integrin $β_1$ headpiece polypeptide comprises, consists essentially of, or consists of one, two, three, or all domain of an integrin $β_1$ polypeptide headpiece (e.g., SEQ ID NO: 4) selected from the group consisting of a PSI domain, hybrid domain, βI domain, and an EGF-1 domain, with at least one Cys residue introduced thereby by substitution of amino acid residue 295 (Leu) with Cys. (SEQ ID NO: 4 includes the signal peptide sequence at positions 1-20.)

In one aspect, a modified integrin polypeptide dimer comprising, consisting essentially of, or consisting of a modified integrin $α_v$ headpiece polypeptide described herein and a modified integrin $β_3$ headpiece polypeptide covalently linked together by at least one disulfide bond is also provided herein. In one embodiment, the modified integrin $β_3$ headpiece polypeptide comprises, consists essentially of, or consists of one, two, three, or all domain of an integrin $β_3$ polypeptide headpiece (e.g., SEQ ID NO: 5) selected from the group consisting of a PSI domain, hybrid domain, βI domain, and an EGF-1 domain, with at least one Cys residue introduced thereby by substitution of amino acid residue 293 (Gln) with Cys. (SEQ ID NO: 5 includes the signal peptide sequence at positions 1-26.)

One aspect provided herein relates to a modified integrin polypeptide dimer comprising, consisting essentially of, or consisting of a modified integrin $α_v$ headpiece polypeptide described herein and a modified integrin $β_8$ headpiece polypeptide covalently linked together by at least one disulfide bond. In one embodiment, the modified integrin $β_8$ headpiece polypeptide comprises, consists essentially of, or consists of one, two, three, or all domain of an integrin $β_8$ polypeptide headpiece (e.g., SEQ ID NO: 6) selected from the group consisting of a PSI domain, hybrid domain, βI domain, and an EGF-1 domain, with at least one Cys residue introduced thereby by substitution of amino acid residue 301 (Val) with Cys. (SEQ ID NO: 6 includes the signal peptide sequence at positions 1-42.)

A further aspect provides a modified integrin polypeptide dimer comprising, consisting essentially of, or consisting of a modified integrin $α_v$ headpiece polypeptide described herein and a modified integrin $β_6$ headpiece polypeptide covalently linked together by at least one disulfide bond. The modified integrin polypeptide dimer comprises, consists essentially of, or consists of (i) an integrin $α_v$ headpiece polypeptide or a functional variant thereof, with at least one or more (e.g., at least one, at least two or more) Cys residues introduced thereto; and (ii) an integrin $β_6$ headpiece polypeptide or a functional variant thereof, with at least one or more (e.g., at least one, at least two or more) Cys residues introduced thereto.

In some embodiments, the modified integrin polypeptide dimer comprises, consists essentially of, or consists of a modified integrin $α_v$ headpiece polypeptide and a modified integrin $β_6$ headpiece polypeptide covalently linked together by at least one or more disulfide bonds, wherein:

the modified integrin $α_v$ headpiece polypeptide comprises, consists essentially of, or consists of an amino acid sequence of an integrin $α_v$ headpiece polypeptide (SEQ ID NO: 1) or a functional variant thereof, with at least one Cys residue introduced thereto by substitution of amino acid residues 399-401 (Ser-Met-Pro) with Ser-Cys-Pro (modification (a)(i)); and the modified integrin $β_6$ headpiece polypeptide comprises, consists essentially of, or consists of an amino acid sequence of an integrin $β_6$ headpiece polypeptide (SEQ ID NO: 2) or a functional variant thereof, with at least one Cys residue introduced thereto by substitution of amino acid residue 270 (Ile) with Cys (modification (f)).

In some embodiments, the modified integrin polypeptide dimer comprises, consists essentially of, or consists of a modified integrin $α_v$ headpiece polypeptide and a modified integrin $β_6$ headpiece polypeptide covalently linked together by at least one or more disulfide bonds, wherein:

the modified integrin $α_v$ headpiece polypeptide comprises, consists essentially of, or consists of an amino acid sequence of an integrin $α_v$ headpiece polypeptide (SEQ ID NO: 1) or a functional variant thereof, with at least one Cys residue introduced thereto by substitution of amino acid residues 399-401 (Ser-Met-Pro) with Gly-Cys-Pro (modification (a)(ii)); and the modified integrin $β_6$ headpiece polypeptide comprises, consists essentially of, or consists of an amino acid sequence of an integrin $β_6$ headpiece polypeptide (SEQ ID NO: 2) or a functional variant thereof, with at least one Cys residue introduced thereto by substitution of amino acid residue 270 (Ile) with Cys (modification (f)).

In some embodiments, the modified integrin polypeptide dimer comprises, consists essentially of, or consists of a modified integrin $α_v$ headpiece polypeptide and a modified integrin $β_6$ headpiece polypeptide covalently linked together by at least one or more disulfide bonds, wherein:

the modified integrin $α_v$ headpiece polypeptide comprises, consists essentially of, or consists of an amino acid sequence of an integrin ac, headpiece polypeptide (SEQ ID NO: 1) or a functional variant thereof, with at least one Cys residue introduced thereto by substitution of amino acid residues 399-401 (Ser-Met-Pro) with Ser-Gly-Cys-Pro (SEQ ID NO: 59) (SEQ ID NO: 59) (modification (a)(v)); and the modified integrin $β_6$ headpiece polypeptide comprises, consists essentially of, or consists of an amino acid sequence of an integrin $β_6$ headpiece polypeptide (SEQ ID NO: 2) or a functional variant thereof, with at least one Cys residue introduced thereto by substitution of amino acid residue 270 (Ile) with Cys (modification (f)).

In some embodiments, the modified integrin polypeptide dimers of various aspects described herein can be soluble polypeptides.

The modified integrin polypeptide dimers (e.g., comprising, consisting essentially of, or consisting of a modified integrin $α_v$ headpiece polypeptide described herein, and a modified integrin $β_6$ headpiece polypeptide described herein) can still interact with a natural ligand as it binds to a naturally occurring integrin heterodimer, but, unlike naturally occurring integrin heterodimers that can reversibly dissociate, the modified headpiece polypeptides described herein do not dissociate and enable formation of a crystallizable structure of an integrin heterodimer, alone or complexed with a test ligand, via formation of a disulfide bridge between the two integrin headpiece subunits. Accordingly, in some aspects, the compositions as described herein can be used to characterize an integrin-ligand interaction, e.g., to measure the binding affinity of a test agent to an integrin heterodimer, e.g., integrin $\alpha_v\beta_6$ heterodimer; and/or to identify a novel integrin ligand, e.g., in a drug discovery process.

For example, a method for determining whether a test agent forms a complex with an integrin is provided herein. The method comprises contacting one or more of the modified polypeptide described herein with a test agent, and detecting formation of a complex comprising the modified integrin polypeptide dimer and the test agent bound thereto. Detection of a formed complex comprising the modified integrin polypeptide dimer and the test agent bound thereto indicates that the test agent is capable of forming a complex with the integrin.

Various methods known in the art can be used to detect formation of a complex comprising the modified integrin polypeptide dimer and a test agent bound thereto. By way of example only, in some embodiments, the complex can be detected by a detection method comprising crystallization of the complex. In some embodiments, the test agent can further comprise a detectable label. Examples of a detectable label include, but are not limited to, biotin, a fluorescent dye or molecule, a luminescent or bioluminescent marker, a radiolabel, an enzyme, a quantum dot, an imaging agent, or any combination thereof. Methods for detecting various types of the detectable labels are known in the art. For example, where the detectable label comprises a fluorescent molecule, signals from the fluorescent labels can be detected, e.g., by fluorescence anisotropy and/or flow cytometry.

In some embodiments, instead of directly detecting a test agent bound to the modified integrin polypeptide dimer, binding of the test agent to the modified integrin polypeptide dimer can also be determined by an indirect method, e.g., a competition binding assay. In a competition binding assay, the method can further comprise, prior to the detecting, contacting the modified integrin polypeptide dimer with a competing agent.

A competing agent is an agent capable of competing with a test agent to bind the modified integrin polypeptide dimer. Accordingly, a competing agent can be a protein, a peptide, an antibody, a nucleic acid molecule, an apatmer, a peptidomimetic, a small molecule, or any combinations thereof. In some embodiments, the competing agent can be a competing peptide. Since the modified integrin polypeptide dimer is crystallizable, the binding domain of the dimer can be readily identified using any methods known in the art, e.g., X-ray crystallography. Based on the binding domain of the dimer, one can design a competing agent that can bind to the binding domain. An exemplary competing peptide for binding to a modified $\alpha_v\beta_6$ polypeptide dimer described herein comprises an amino acid sequence of $X_3$-Arg-Gly-Asp-Leu-$X_1$-$X_2$-Leu (SEQ ID NO: 66), wherein $X_1$, $X_2$, and $X_3$ are each independently an amino acid molecule. An alternative competing peptide for binding to a modified $\alpha_v\beta_6$ polypeptide dimer described herein comprises an amino acid sequence of $X_3$-Arg-Gly-Asp-Leu-$X_1$-$X_2$-Ile (SEQ ID NO: 67), wherein $X_1$, $X_2$, and $X_3$ are each independently an amino acid molecule.

In Some Embodiments, the $X_1$ can be a Gly Molecule or an Analog Thereof.

In some embodiments, the $X_2$ can be an Arg molecule or an analog thereof.

In some embodiments, the $X_3$ can be a Gly molecule or an analog thereof.

In some embodiments, a competing peptide for binding to a modified $\alpha_v\beta_6$ polypeptide dimer described herein can comprise an amino acid sequence of Gly-Arg-Gly-Asp-Leu-Gly-Arg-Leu (SEQ ID NO: 68). In some embodiments, a competing peptide for binding to a modified $\alpha_v\beta_6$ polypeptide dimer described herein can comprise an amino acid sequence of Gly-Arg-Gly-Asp-Leu-Gly-Arg-Ile (SEQ ID NO: 69).

In some embodiments, the competing agent can further comprise a detectable label. Examples of a detectable label include, but are not limited to, biotin, a fluorescent dye or molecule, a luminescent or bioluminescent marker, a radiolabel, an enzyme, a quantum dot, an imaging agent, or any combination thereof. Methods for detecting various types of the detectable labels are known in the art. For example, where the detectable label comprises a fluorescent molecule, signals from the fluorescent labels can be detected, e.g., by fluorescence anisotropy and/or flow cytometry.

Where the competing agent comprises a detectable label, signals from the competing agent is detected instead of the test agent. Thus, if the signal from the competing agent is reduced upon contacting the modified integrin polypeptide dimer with the test agent, this indicates that the test agent has a higher binding affinity than the competing agent to the modified integrin polypeptide dimer described herein.

Accordingly, yet another aspect provided herein relates to a method for determining binding affinity of a test agent to an integrin. The method comprises (i) contacting one or more modified integrin polypeptide dimers described herein with a test agent and a competing agent, wherein the competing agent comprises a detectable label and is capable of competing with the test agent to bind the modified integrin polypeptide dimer; and (ii) detecting a signal from the detectable label of the competing agent that forms a complex with the integrin, whereby a decrease in the detected signal relative to a signal corresponding to saturation binding of the competing agent to the modified integrin polypeptide dimer indicates that the test agent has a higher binding affinity than the competing agent to the integrin. In some embodiments, the concentrations of the test agent and the competing agent are essentially the same.

As noted above, the modified integrin polypeptide dimers described herein can form crystal structures. Thus, the binding domain of the dimer can be readily identified using any methods known in the art, e.g., X-ray crystallography. Indeed, the inventors have identified a novel hydrophobic binding pocket of an integrin $\alpha_v\beta_6$ heterodimer based on the crystal structure thereof. Accordingly, inventors employ the information of the novel hydrophobic binding pocket to design a pharmacophore model for an agent that can bind to the hydrophobic binding pocket of the integrin $\alpha_v\beta_6$ heterodimer.

In some embodiments, the pharmacophore model can be designed for an anti-$\alpha_v\beta_6$ inhibitor. Therefore, provided herein is also a method of identifying an anti-$\alpha_v\beta_6$ inhibitor. The method comprises: (a) generating on a computer a molecular representation of a pharmacophore comprising a basic functional group, an acidic functional group for coordination of a metal ion to a metal ion-dependent adhesion site (MIDAS) in integrin β6 subunit, a first hydrophobic functional group, and a second hydrophobic functional group, wherein the functional groups are arranged to satisfy the following conditions:

the distance between the first hydrophobic functional group (H1) and the second hydrophobic functional group (H2) is about 7-8 Å; the distance between the second hydrophobic functional group (H2) and the basic functional group (B) is about 8-9 Å; the distance between the basic functional group (B) and the acidic functional group (A) is about 15-16 Å; the distance between the first hydrophobic functional group (H1) and the acidic functional group (A) is about 14.5-15.5 Å; and the distance between the second hydrophobic functional group (H2) and the acidic functional group (A) is about 19-20 Å; and the angle formed by H1-A-B is about 20°-24°; the angle formed by H1-A-H2 is about 17°-21°; the angle formed by H2-A-B is about 26°-30°; the angle formed by A-B-H1 is about 68°-72°; the angle formed by A-B-H2 is about 96°-100°; and the angle formed by H1-B-H2 is about 49°-530; (b) generating on a computer atomic coordinates of an $\alpha_v\beta_6$ integrin protein or a portion thereof having at least a hydrophobic binding pocket in $\beta_6$ subunit; and (c) determining on a computer likelihood of the molecular representation interacting with one or more residues of the computer-generated $\alpha_v\beta_6$ integrin protein or a portion thereof, thereby identifying a candidate anti-$\alpha_v\beta_6$ inhibitor.

For example, one can use the following: the distance between the first hydrophobic functional group and the second hydrophobic functional group is about 7.403 Å; the distance between the second hydrophobic functional group and the basic functional group is about 8.462 Å; the distance between the basic functional group and the acidic functional group is about 15.639 Å; the distance between the first hydrophobic functional group and the acidic functional group is about 15.005 Å; and the distance between the second hydrophobic functional group and the acidic functional group is about 19.553 Å; and the angle formed by H1-A-B is about 22.4°; the angle formed by H1-A-H2 is about 19.4°; the angle formed by H2-A-B is about 28.7°; the angle formed by A-B-H1 is about 70.7°; the angle formed by A-B-H2 is about 98.1°; and the angle formed by H1-B-H2 is about 51.1°.

In some embodiments, the first and second hydrophobic functional groups can each independently have an aromatic ring (aryl) or linear moiety.

In another aspect, provided herein is a method of identifying an anti-$\alpha_v\beta_6$ inhibitor. The method comprises or consists of or consists essentially of: (a) providing, on a computer, a three-dimensional crystalline structure of $\alpha_v\beta_6$ integrin protein or a portion thereof characterized by atomic structure coordinates (e.g., as described in Table 6 of, PCT Application No: PCT/US15/44093 filed Aug. 6, 2015) or a three-dimensional structure that exhibits a root-mean-square difference (rmsd) in $\alpha$-carbon positions of less than 2.0 Å (or less than 1.0 Å) with the atomic structure coordinates (e.g., as described in Table 6 of PCT Application No: PCT/US15/44093 filed Aug. 6, 2015); (b) docking on the computer a first molecular entity in a first part of a binding pocket of the integrin $\beta_6$ headpiece polypeptide having an amino acid sequence of SEQ ID NO: 2, to determine the binding association between the first molecular entity and the first part of the binding pocket, wherein the binding pocket comprises amino acid residues Ala-217, Asn-218, Pro-179, Cys-180, Ile-183, Ala-126, and Tyr-185; (c) docking on the computer a second molecular entity in a second part of the binding pocket, to determine the binding association between the second molecular entity and the second part of the binding pocket; (d) repeating steps (b) to (c) with a different first and second molecular entity; (e) selecting a first and a second chemical entity based on the quantified binding associations; and (f) generating on the computer a pharmacophore model by assembling the selected first and second molecular entity into a molecular representation that interacts with the binding pocket.

In some embodiments of this aspect and other aspects described herein, the method can further comprise contacting the candidate anti-$\alpha_v\beta_6$ inhibitor (based on the pharmacophore model) with a $\alpha_v\beta_6$ integrin protein to determine the ability of the candidate anti-$\alpha_v\beta_6$ integrin inhibitor to bind the $\alpha_v\beta_6$ integrin protein.

In a further aspect, provided herein is a crystalline composition comprising a ligand-binding headpiece of integrin $\alpha_v\beta_6$, wherein the crystalline composition is characterized with space group C2, and has unit cell parameters a=184.5±3 Å, b=168.3±3 Å, c=101.8±3 Å, $\alpha=\beta=90°$, and $\gamma=98.20±3°$.

In some embodiments, the crystalline composition can further comprise a ligand. Accordingly, a crystalline composition comprising a ligand-binding headpiece of integrin $\alpha_v\beta_6$ and a ligand is also provided herein. The crystalline composition is characterized with space group C2, and has unit cell parameters a=184.4±3 Å, b=170.0±3 Å, c=102.4±3 Å, $\alpha=\beta=90°$, and $\gamma=98.7°±3°$.

In some embodiments, the ligand-binding headpiece of integrin $\alpha_v\beta_6$ can comprise a modified integrin $\alpha_v$ headpiece polypeptide described herein, and a modified integrin $\beta_6$ headpiece polypeptide described herein.

In some embodiments, the crystalline composition has a binding pocket in the modified integrin $\beta_6$ headpiece polypeptide, wherein the binding pocket comprises amino acid residues Ala-217, Asn-218, Pro-179, Cys-180, Ile-183, Ala-126, and Tyr-185.

In some embodiments, the ligand-binding headpiece of integrin $\beta_6$ can be described by its atomic structure coordinates (e.g., described in Table 6 of PCT Application No: PCT/US15/44093 filed Aug. 6, 2015, or a structure that exhibits a root-mean-square difference (rmsd) in $\alpha$-carbon positions of less than 2.0 Å (or less than 1.0 Å) with the atomic structure coordinates (e.g. described in Table 6. of PCT Application No: PCT/US15/44093 filed Aug. 6, 2015.

In some embodiments, the crystalline composition can be formed from a crystallization solution buffered between pH 6-8 at a temperature of about 20° C. or room temperature and having an ionic strength of about 800-900 mM.

By introducing at least one disulfide bond to an integrin dimer, the interaction between the integrin ca subunit and the integrin $\beta$ subunit, unlike the wild-type integrin dimer, is irreversible, and thus crystal structure of the disulfide-linked integrin dimer can be formed with a high resolution, which can then used for various applications, e.g., pharmacophore modeling, and/or drug screening. Accordingly, a method of identifying an anti-$\alpha_v\beta_3$ inhibitor is also provided herein. The method comprises: (a) providing, on a computer, a three-dimensional crystalline structure of $\alpha_v\beta_3$ integrin protein or a portion thereof characterized by atomic structure coordinates (e.g., as described in Table 8 of PCT Application No: PCT/US15/44093 filed Aug. 6, 2015 or a three-dimensional structure that exhibits a root-mean-square difference (rmsd) in $\alpha$-carbon positions of less than 2.5 Å (or less than 2.0 Å, or less than 1.0 Å) with the atomic structure coordinates (e.g., described in Table 8 of PCT Application No: PCT/US15/44093 filed Aug. 6, 2015); (b) docking on the computer a first molecular entity in a first part of a binding pocket of the integrin $\beta_3$ headpiece polypeptide having an amino acid sequence of SEQ ID NO: 5 or a fragment thereof (with desired domain(s)), to determine the binding association between the first molecular entity and the first part of the binding pocket; (c) docking on the computer a second molecular entity in a second part of the binding pocket, to determine the binding association between the second molecular entity and the second part of the binding pocket; (d) repeating steps (b) to (c) with a different first and second molecular entity; (e) selecting a first and a second chemical entity based on the quantified binding associations; and (f) generating on the computer a pharmacophore model by assembling the selected first and second molecular entity into a molecular representation that interacts with the binding pocket.

In some embodiments, the method can further comprise contacting the candidate anti-$\alpha_v\beta_3$ inhibitor (based on the pharmacophore model) with an $\alpha_v$ $\beta_3$ integrin protein to determine the ability of the candidate anti-$\alpha_v\beta_3$ integrin inhibitor to bind the $\alpha_v\beta_3$ integrin protein.

A crystalline composition comprising a ligand-binding headpiece of integrin $\alpha_v\beta_3$ is also provided herein. The crystalline composition is characterized with space group $P22_12_1$, and has unit cell parameters a=87±2 Å, b=124±2 Å, c=165±2 Å, $\alpha=\beta=90°$, and $\gamma=90°\pm3°$. In some embodiments, the ligand-binding headpiece of integrin $\alpha_v\beta_3$ can comprise a modified integrin $\alpha_v$ headpiece polypeptide described herein, and a modified integrin $\beta_3$ headpiece polypeptide described herein. In some embodiments, the ligand-binding headpiece of integrin $\alpha_v$ $\beta_3$ can be described by its atomic structure coordinates (e.g., as described in Table 8 of PCT Application No: PCT/US15/44093 filed Aug. 6, 2015), or a structure that exhibits a root-mean-square difference (rmsd) in $\alpha$-carbon positions of less than 2.5 Å (or less than 2.0 Å, or less than 1.0 Å) with the atomic structure coordinates (e.g., as described in Table 8 of PCT Application No: PCT/US15/44093 filed Aug. 6, 2015). In some embodiments, the crystal composition can be formed from a crystallization solution buffered between pH 6-8 at a temperature of about 20° C. and having an ionic strength of about 800-900 mM.

Another aspect provided herein relates to a crystalline composition comprising a ligand-binding headpiece of integrin $\alpha_v\beta_8$. The ligand-binding headpiece of integrin $\alpha_v\beta_8$ is characterized with space group P1, and has unit cell parameters a=153±3 Å, b=55±3 Å, c=181±3 Å, $\alpha=\beta=90°$, and $\gamma=110°\pm3°$. In some embodiments, the ligand-binding headpiece of integrin $\alpha_v\beta_8$ can comprise a modified integrin $\alpha_v$ headpiece polypeptide described herein, and a modified integrin $\beta_8$ headpiece polypeptide described herein. In some embodiments, the crystal composition can be formed from a crystallization solution buffered between pH 6-8 at a temperature of about 20° C. and having an ionic strength of about 800-900 mM.

The crystalline composition can be used for various applications, including, e.g., drug screening or pharmacophore modeling. Thus, a method of identifying an anti-$\alpha_v\beta_8$ inhibitor is also provided herein. The method comprises: (a) providing, on a computer, a three-dimensional crystalline structure of $\alpha_v\beta_8$ integrin protein or a portion thereof derived from the crystalline composition comprising a ligand-binding headpiece of integrin $\alpha_v\beta_8$ described herein; (b) docking on the computer a first molecular entity in a first part of a binding pocket of the integrin $\beta_8$ headpiece polypeptide having an amino acid sequence of SEQ ID NO: 6 or a fragment thereof (e.g., with desired domain(s)), to determine the binding association between the first molecular entity and the first part of the binding pocket; (c) docking on the computer a second molecular entity in a second part of the binding pocket, to determine the binding association between the second molecular entity and the second part of the binding pocket; (d) repeating steps (b) to (c) with a different first and second molecular entity; (e) selecting a first and a second chemical entity based on the quantified binding associations; and (f) generating on the computer a pharmacophore model by assembling the selected first and second molecular entity into a molecular representation that interacts with the binding pocket. In some embodiments, the method can further comprise contacting the candidate anti-$\alpha_v\beta_8$ inhibitor (based on the pharmacophore model) with an $\alpha_v\beta_8$ integrin protein to determine the ability of the candidate anti-$\alpha_v\beta_8$ integrin inhibitor to bind the $\alpha_v\beta_8$ integrin protein.

Kits comprising at least one of the modified integrin headpiece polypeptides or fragments thereof (e.g., but not limited to the modified integrin $\alpha_v$ headpiece polypeptides described herein, and/or the modified integrin $\beta_6$ headpiece polypeptides described herein) and/or at least one of the modified integrin polypeptide dimers are also provided herein.

In some embodiments, the modified integrin headpiece polypeptides and/or the modified integrin polypeptide dimers included in the kit can be attached to a solid surface.

In some embodiments, the kit can further comprise at least one reagent to perform the methods described herein. For example, in one embodiment, at least one competing agent as described herein can be included in the kit.

Polynucleotides encoding the modified integrin headpiece polypeptides (e.g., the modified integrin $\alpha_v$ headpiece polypeptides described herein, and the modified integrin $\beta_6$ headpiece polypeptides described herein) are also encompassed within the scope of the inventions described herein.

BRIEF DESCRIPTION OF THE DRAWINGS

(FIG. 1A) The indicated 293T transfectants were assayed for TGF-$\beta$1 activation using mink lung luciferase reporter cells. (FIG. 1B) Saturation binding of FITC-pro-TGF-$\beta$1 to 293T transfectants as % mean fluorescence intensity (MFI) of $\alpha_v$ P2W7 mAb binding. (FIG. 1C) Binding of peptides to $\alpha_v\beta_6$ headpiece measured by fluorescence anisotropy (peptides disclosed as SEQ ID NOS 80-81, 75, and 72, respectively, in order of appearance). (FIG. 1D) Binding of peptides to $\alpha_v\beta_3$ headpiece measured by fluorescence anisotropy. Data show mean±SEM of triplicate samples.

(FIG. 2A) Overall ribbon diagram of $\alpha_v\beta_6$ headpiece with pro-TGF-$\beta$3 peptide. (FIG. 2B) Conformational change of the $\beta$I $\alpha$2-$\alpha$3 loop in absence and presence of pro-TGF-$\beta$3. Carbons are shown. Metals are white or grey spheres. (FIG. 2C) pH-dependence of binding affinity. Binding of FITC-pro-TGF-$\beta$3 peptide was measured using fluorescence anisotropy. (FIG. 2D) Ligand binding of $\alpha_v\beta_6$ to pro-TGF-$\beta$3 peptide. Carbons are shown. (FIG. 2E) Ligand binding of $\alpha_v\beta_3$ to cilengitide as described in Xiong et al., Science 296 (2002) 51-155. Carbons are shown. (FIGS. 2F and 2G) Key residues that contribute to packing between SDL1, 2, and 3 in $\beta_6$ (FIG. 2F) and $\beta_3$ (FIG. 2G). Van der Waals surfaces around interacting sidechains are shown as dots. (FIG. 2H) Phylogenetic tree for integrin $\beta$ subunit SDL sequences as described in Huhtala et al., Matrix Biol. 24 (2005) 83. Ligand contacting residues in SDL1 and SDL3 in $X_1$ positions are highlighted in a darker shade. Residues that form packing interactions of SDL1 and 3 with SDL2 in $X_2$ position are highlighted in medium shade. Cysteines forming disulfides are highlighted in a lighter shade. Residues that coordinate metals are asterisked and indicated in the figure. Metal ion-dependent adhesion site (MIDAS), adjacent to MIDAS (ADMIDAS); synergistic metal binding site (SyMBS). FIG. 2H discloses SEQ ID NOS 82-105, respectively, in order of appearance.

(FIG. 3A) RGD sequences from pro-TGF-β and VP1 protein from foot-and-mouth disease virus (SEQ ID NOS 106-107, 78, and 108, respectively, in order of appearance). (FIG. 3B) Competitive binding affinities of TGF-β3 peptide truncations (SEQ ID NOS 78 and 109-114, respectively, in order of appearance). Fluorescence anisotropy data are mean±SEM of triplicate samples scaled logarithmically. (FIG. 3C) Western blots of proTGF-β1 secreted by the indicated 293T transfectants using antibody to the prodomain as described in Wang et al., Mol BIol. Cell 23 (2012) 1129. (FIG. 3D) TGF-β bioassay of proTGF-β1 and its double proline mutant.

FIG. 10 shows an amino acid sequence of an integrin $\beta_8$ subunit. The signal sequence is indicated in a line box. The PSI domain is highlighted in bold. The hybrid domain is highlighted in grey. The βI domain is highlighted in black. The EGF-1 domain is underlined.

DETAILED DESCRIPTION

Figure 1A:
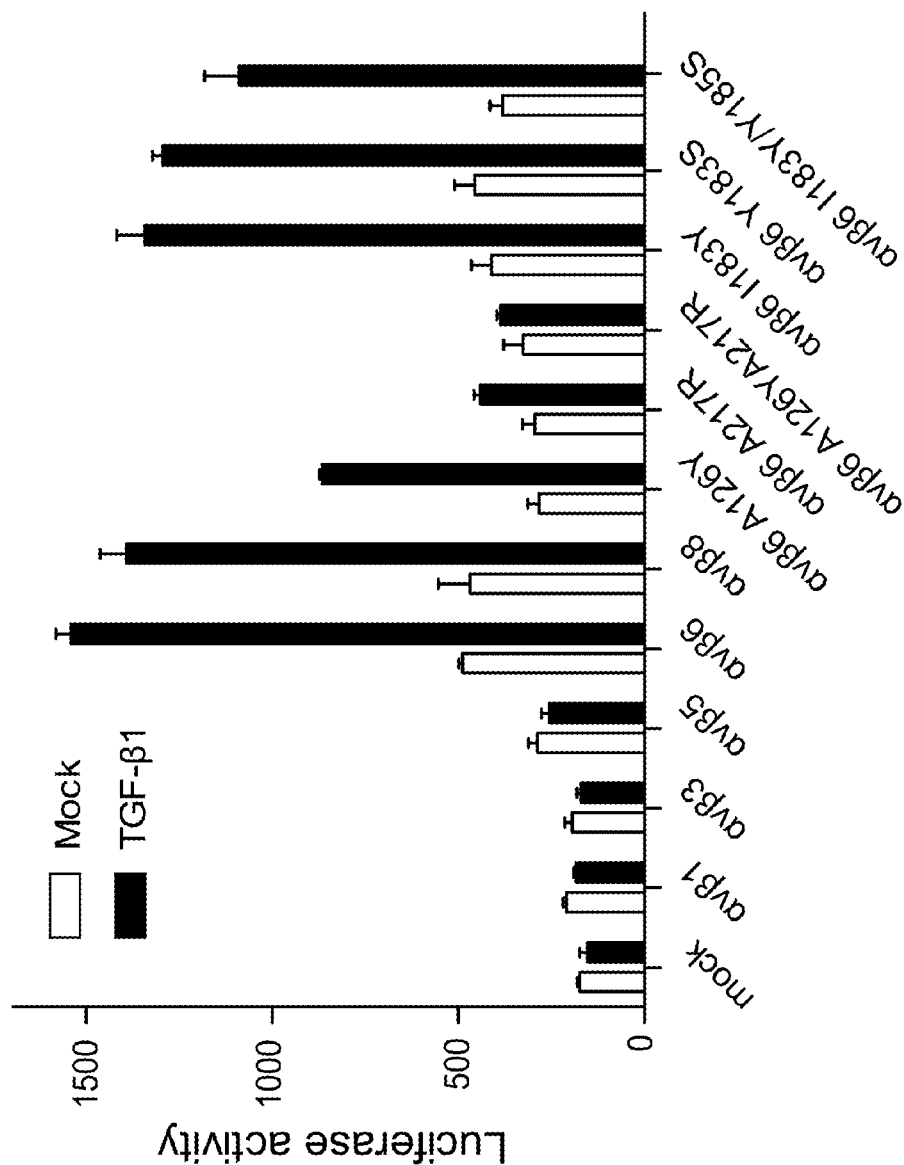
FIGS. 1A-1D show activation and binding of pro-TGF-$\beta$ by wild-type (WT) and mutant $\alpha_v$ integrins.

As integrins are generally non-covalently linked heterodimers of α and β subunits, the integrin heterodimers can reversibly dissociate into α and μ subunits. Therefore, characterizing an integrin-binding interaction and/or identifying a ligand that binds to the integrin heterodimer can be difficult. The inventors have developed cross-linkable integrin α and β polypeptide subunits, which can form covalently-linked α/β heterdimers through at least one disulfide bond.

For example, the inventors have modified the integrin α and β headpiece polypeptide subunits by introducing at least one or more cysteine residues into one or both of the α and β headpiece polypeptide subunits. For example, the inventors have modified integrin $\alpha_v$ and $\beta_6$ headpiece polypeptide subunits to introduce a disulfide bond that can covalently link the two subunits together. Aspects of the invention can also be applied to other integrins that have homologous sequences or similar structures. The inventors utilized the crystal instructure of integrin $\alpha_v\beta6$ heterodimer to select, one or more residues at specific locations in domain(s) that are distal from the ligand-binding sites, e.g., residue(s) in the $\alpha_v$ subunit β-propeller domain and in the $\beta_6$ subunit βI-domain, and modified them to introduce a cysteine substitution. In some embodiments, the inventors further added an extra glycine residue into the integrin $\alpha_v$ headpiece polypeptide at specific locations. Such modifications resulted in ability, e.g., to further improve crystallization and/or expression of an integrin heterodimer, such as $\alpha_v\beta_6$ heterodimer, without or upon binding with a test agent.

Thus, in one aspect, the covalently-linked integrin heterodimers, such as integrin $\alpha_v\beta_6$ heterodimers can be used to facilitate discovery of novel ligands for integrin $\alpha_v\beta_6$ heterodimers. Further, based on the covalently-linked integrin $\alpha_v\beta_6$ heterodimer, the inventors have identified a novel hydrophobic binding pocket as a target site in the headpiece for these integrins, thus facilitating discovery of potent ligands or inhibitors against these integrins.

In addition, the inventors have introduced cysteine(s) in integrin $\beta_3$ and $\beta_8$ subunits at the same position structurally as in the integrin $\beta_6$ subunit, and thus generated covalently-linked integrin $\alpha_v\beta_3$ and $\alpha_v\beta_8$ heterodimers, which can be crystallized to form more stable crystal structures with a much higher resolution (e.g., less than 3 Å or less than 2 Å or less than 1 Å).

Generally, a full integrin αβ headpiece dimer is a 6-domain structure, as a wild-type integrin α headpiece polypeptide includes β-propeller domain and a thigh domain, while a wild-type integrin β headpiece polypeptide includes a βI domain, a hybrid domain, a PSI (plexin, semaphoring, and integrin) domain, and an I-EGF-1 (or EGF-1) domain. Here, the inventors have surprisingly discovered that a 3-domain integrin fragment of the αβ headpiece dimer, which contains only the α β-propeller and thigh domains and the β βI domain, and is crosslinked using a disulfide bond as described herein, can be generated with good expression. In one embodiment, the inventors have created a functional 3-domain disulfide-linked integrin fragment of the $\alpha_v\beta_6$ headpiece dimer that is capable of binding a ligand as the corresponding full headpiece. Such an integrin fragment has never been previously made in good yield, but the inventors were successfully able to express such a 3-domain integrin fragment by introducing a disulfide bond to cross-link (covalently-link) the α headpiece and the β headpiece fragment. Thus, not only have the inventors generated disulfide-linked full headpiece of integrin dimers, but they have also successfully generated functional fragments of integrin headpiece dimers (e.g., 3-domain structure) that can bind a ligand as the corresponding full headpiece dimer. Accordingly, fragments of modified integrin αβ polypeptide dimers, e.g., 3-domain structure, 4-domain structure, and 5-domain structure, are also described herein. The multi-domain structures can be formed from any combination of the 6 domains derived from the integrin α and β headpieces.

In some embodiments, the 3-domain integrin polypeptide dimer can comprise, essentially consist of, or consist of a β-propeller domain and a thigh domain of a modified integrin α headpiece incorporated with at least one or more cysteine substitutions as described herein (e.g., modified integrin $α_v$ headpiece polypeptide described herein), and a βI domain of a modified integrin β headpiece incorporated with at least one or more cysteine substitutions as described herein (e.g., modified integrin $β_6$ headpiece polypeptide described herein). In some embodiments, the 4-domain integrin polypeptide dimer can comprise, essentially consist of, or consist of a β-propeller domain and a thigh domain of a modified integrin α headpiece incorporated with at least one or more cysteine substitutions as described herein (e.g., modified integrin $α_v$ headpiece polypeptide described herein), and a βI domain and a hybrid domain of a modified integrin β headpiece incorporated with at least one or more cysteine substitutions as described herein (e.g., modified integrin $β_6$ headpiece polypeptide described herein). In some embodiments, the 5-domain integrin polypeptide dimer can comprise, essentially consist of, or consist of a β-propeller domain and a thigh domain of a modified integrin α headpiece incorporated with at least one or more cysteine substitutions as described herein (e.g., modified integrin $α_v$ headpiece polypeptide described herein), and a βI domain, a hybrid domain, and a PSI domain of a modified integrin β headpiece incorporated with at least one or more cysteine substitutions as described herein (e.g., modified integrin $β_6$ headpiece polypeptide described herein).

Accordingly, various aspects described herein provide for compositions (e.g., modified integrin headpiece polypeptides and functional variants/fragments thereof, and crystallizable integrin polypeptide dimers comprising at least one modified integrin headpiece polypeptide) and methods of using the same. In some embodiments, the methods described herein comprise using one or more of the compositions described herein to characterize an integrin-ligand interaction and/or to identify whether a test agent forms a complex with the integrin. In some embodiments, the methods described herein comprise using one or more of the compositions described herein to determine binding affinity of a test agent to an integrin. Methods for identifying a ligand that binds to integrin $α_vβ_6$ heterodimer (e.g., an anti-$α_vβ_6$ inhibitor) are also provided herein.

Modified Integrin α Headpiece Polypeptide (e.g., Modified Integrin $α_v$ Headpiece Polypeptides)

One aspect provided herein relates to a modified integrin α headpiece polypeptide comprising, consisting essentially of, or consisting of an amino acid sequence of an integrin α headpiece polypeptide or a functional variant thereof, with at least one or more (e.g., at least one, at least two, at least three or more) Cys residues introduced into.

In some embodiments, Cys residue(s) can be introduced into domain(s) of an integrin α headpiece polypeptide that are distal from a ligand-binding site. The modified integrin α headpiece polypeptide can substantially retain the functionality (e.g., ligand-binding capability) of the naturally occurring integrin α headpiece polypeptide (e.g., retain at least about 50%, at least about 60%, at least about 70%, at least about 80%, at least about 90%, at least about 95%, at least about 97%, at least about 99% or more and up to 100%), while having the ability to form a disulfide bond with an integrin β polypeptide or a modified integrin β headpiece polypeptide described herein.

As used herein, the term "distal from a ligand-binding site" refers to any amino acid residue or domain that does not participate in ligand binding such that modification(s) to the amino acid residue or domain does not substantially impair a ligand binding to the ligand-binding site.

As used herein, the term "ligand-binding site" refers to a particular region or regions of a protein or polypeptide to which a ligand binds to form a complex with the protein or polypeptide. A region can comprise one or more individual amino acid residues. In accordance with various aspects described herein, the ligand-binding site is generally present in an integrin headpiece, which is further described below.

The term "ligand" is generally meant to refer to a small molecule having affinity for a target molecule, e.g., a protein molecule. Generally, a ligand can preferentially bind to a target molecule at one or more particular sites.

A Cys residue can be introduced into one or more domain(s) of an integrin α headpiece polypeptide by any methods of modifying amino acids known in the art, including, e.g., substitution, deletion and/or addition of an amino acid or amino acid analog. In some embodiments, at least one or more Cys residue or an analog thereof can be introduced into one or more domain(s) of the integrin α headpiece polypeptide by substitution of an amino acid residue, and/or addition of a Cys residue or an analog thereof. In some embodiments, while introducing one or more Cys residue into at least one domain of the integrin α headpiece polypeptide, one or more other amino acid residues present in the integrin α headpiece polypeptide can also be deleted.

As used herein, the term "analog" when used in reference to an amino acid residue or molecule refers to a molecule that retains the same structure or characteristic (e.g., size, charges and/or interactions) as a parent amino acid residue or molecule. In some embodiments, the analog can include a non-proteinogenic amino acid derived from a proteinogenic amino acid.

As used herein, the term "integrin α headpiece polypeptide" refers to a polypeptide that is similar or identical to the sequence of wild-type integrin α polypeptide having at least the headpiece thereof. An integrin α headpiece polypeptide generally includes β-propeller domain and/or a thigh domain, and confers ligand-binding capability upon binding with an appropriate integrin β headpiece polypeptide. An integrin α headpiece polypeptide can be derived from the headpiece of any integrin α polypeptide, including, for example, $α_1$, $α_2$, $α_3$, $α_4$, $α_5$, $α_6$, $α_7$, $α_8$, $α_9$, $α_{10}$, $α_{11}$, $α_D$, $α_E$, $α_L$, $α_M$, $α_v$, $α_{2B}$, and $a_X$. In some embodiments, the term "integrin α headpiece polypeptide" refers to a polypeptide having an amino acid sequence that is at least 70% or more (including at least 75%, at least 80%, at least 85%, at least 90%, at least 95%, at least 97%, at least 99%, or 100%) identical to that of a wild-type integrin α polypeptide having at least the headpiece thereof (including, e.g., β-propeller and/or thigh domains), and is capable of interacting with an integrin β subunit (e.g., a headpiece) to form a heterodimer and retaining (e.g., at least 70% or more of) the biological activity of the wild-type heterodimer, including, but not limited to, ligand binding, cellular adhesion, migration, invasion, differentiation, proliferation, apoptosis, and/or gene expression. In some embodiments, the term "integrin α headpiece polypeptide" refers to a polypeptide that is similar or identical to the sequence of a wild-type integrin α headpiece polypeptide (including, e.g., β-propeller and/or thigh domains). In some embodiments, the integrin α headpiece polypeptide can further include other domain(s) of a wild-type integrin α polypeptide such as calf-1 and/or calf-2 domains that form the lower legs of the wild-type integrin α polypeptide. In some embodiments, an integrin α headpiece polypeptide refers to a full-length wild-type integrin α headpiece polypeptide sequence. In some embodiments, an integrin α headpiece polypeptide refers to a functional domain or domains of an integrin α headpiece polypeptide that interacts with an integrin β headpiece polypeptide (as defined herein) to form a heterodimer comprising a ligand-binding site. The wild-type integrin α polypeptide sequences (comprising the ligand-binding headpiece and other domains that form the lower leg including, e.g., calf-1 and calf-2 domains) of various species are available on the world wide web from the NCBI, including human and mouse. For example, the amino acid sequences of human integrin α polypeptides and the corresponding nucleotide sequences encoding the integrin at polypeptides are available at NCBI under GI numbers shown in Table 1 below. A skilled artisan can identify an integrin α headpiece sequence from the corresponding integrin α polypeptide/polynucleotide sequence, based on the known locations of, e.g., β-propeller domains, and ligand-binding sites, within the sequence.

TABLE 1

Sequences of human integrin α polypeptide subunits

| Human integrin α polypeptide | Amino acid sequence (GI number) | Nucleotide sequence (GI number) |
| --- | --- | --- |
| $\alpha_1$ | 187957526 (SEQ ID NO: 7) | 187957525 (SEQ ID NO: 25) |
| $\alpha_2$ | 21105795 (SEQ ID NO: 8) | 21105794 (SEQ ID NO: 26) |
| $\alpha_3$ | 186497 (SEQ ID NO: 9) | 186496 (SEQ ID NO: 27) |
| $\alpha_4$ | 903744 (SEQ ID NO: 10) | 903743 (SEQ ID NO: 28) |
| $\alpha_5$ | 14250644 (SEQ ID NO: 11) | 33870036 (SEQ ID NO: 29) |
| $\alpha_6$ | 33944 (SEQ ID NO: 12) | 33943 (SEQ ID NO: 30) |
| $\alpha_7$ | 2897116 (SEQ ID NO: 13) | 2897115 (SEQ ID NO: 31) |
| $\alpha_8$ | 41393678 (SEQ ID NO: 14) | 41393677 (SEQ ID NO: 32) |
| $\alpha_9$ | 52485941 (SEQ ID NO: 15) | 52485940 (SEQ ID NO: 33) |
| $\alpha_{10}$ | 6650628 (SEQ ID NO: 16) | 6650627 (SEQ ID NO: 34) |
| $\alpha_{11}$ | 52485853 (SEQ ID NO: 17) | 52485852 (SEQ ID NO: 35) |
| $\alpha_D$ | 62548866 (SEQ ID NO: 18) | 62548865 (SEQ ID NO: 36) |
| $\alpha_E$ | 148728188 (SEQ ID NO: 19) | 148728187 (SEQ ID NO: 37) |
| $\alpha_L$ | 37515696 (SEQ ID NO: 20) | 37515695 (SEQ ID NO: 38) |
| $\alpha_M$ | 68563402 (SEQ ID NO: 21) | 109730155 (SEQ ID NO: 39) |
| $\alpha_V$ | 187953251 (SEQ ID NO: 22) | 187953250 (SEQ ID NO: 40) |
| $\alpha_{2B}$ | 116497075 (SEQ ID NO: 23) | 116497074 (SEQ ID NO: 41) |
| $\alpha_X$ | 556503454 (SEQ ID NO: 24) | 556503453 (SEQ ID NO: 42) |

As used herein and throughout the specification, the term "functional variant" refers to a molecule, e.g., a polypeptide, that retains at least about 70% or more (including at least 75%, at least 80%, at least 85%, at least 90%, at least 95%, at least 97%, at least 99%, or 100%) of the biological activity of a wild-type molecule, e.g., interaction with an integrin ca headpiece polypeptide or an integrin β headpiece polypeptide to form a heterodimer comprising a ligand-binding site that retains (e.g., at least 70% or more of) the biological activity of the wild-type heterodimer, including, but not limited to, ligand binding, cellular adhesion, migration, invasion, differentiation, proliferation, apoptosis, and/or gene expression. The term "functional variant" as used herein also encompasses conservative substitution variants of a polypeptide that retain at least about 70% or more (including at least 75%, at least 80%, at least 85%, at least 90%, at least 95%, at least 97%, at least 99%, or 100%) of the biological activity of a wild-type molecule, e.g., interaction with an integrin α headpiece polypeptide or an integrin β headpiece polypeptide to form a heterodimer comprising a ligand-binding site that retains (e.g., at least 70% or more of) the biological activity of the wild-type heterodimer, including, but not limited to, ligand binding, cellular adhesion, migration, invasion, differentiation, proliferation, apoptosis, and/or gene expression.

"Conservative" amino acid substitutions can be made on the basis of similarity in any of a variety or properties such as side chain size, polarity, charge, solubility, hydrophobicity, hydrophilicity, and/or amphipathicity of the residues involved. For example, the non-polar (hydrophobic) amino acids include alanine, leucine, isoleucine, valine, glycine, proline, phenylalanine, tryptophan and methionine. The polar (hydrophilic), neutral amino acids include serine, threonine, tyrosine, asparagine, and glutamine. The positively charged (basic) amino acids include arginine, lysine and histidine. The negatively charged (acidic) amino acids include aspartic acid and glutamic acid. In some embodiments cysteine is considered a non-polar amino acid. In some embodiments insertions or deletions may range in size from about 1 to 20 amino acids, e.g., 1 to 10 amino acids. In some instances larger domains may be removed without substantially affecting function.

The amino acid identity between two polypeptides can be determined, for example, by first aligning the two polypeptide sequences using an alignment algorithm, such as BLAST® or by other methods well-known in the art.

In some embodiments, a modified integrin α headpiece polypeptide comprises, consists essentially of, or consists of an amino acid sequence of an integrin $\alpha_v$ headpiece polypeptide or a functional variant thereof, with at least one Cys residue introduced into.

Accordingly, in one aspect, provided herein is a modified integrin $\alpha_v$ headpiece polypeptide. The modified integrin $\alpha_v$ headpiece polypeptide comprises, consists essentially of, or consists of an amino acid sequence of an integrin $\alpha_v$ headpiece polypeptide (SEQ ID NO:1) or a functional variant thereof, with at least one Cys residue introduced thereto by one or more (e.g., at least one, at least two or more) of the following modifications (a)-(e):

a. substitution of amino acid residues 399-401 (Ser-Met-Pro) with one of the following: (i) Ser-Cys-Pro; (ii) Gly-Cys-Pro; (iii) Ser-Cys-Gly; (iv) Gly-Cys-Gly; (v) Ser-Gly-Cys-Pro (SEQ ID NO: 59); (vi) Ser-Cys-Gly-Pro (SEQ ID NO: 60); (vii) Gly-Cys-Gly-Pro (SEQ ID NO: 61); and (viii) Ser-Gly-Cys-Gly (SEQ ID NO: 62).
b. substitution of amino acid residues 310-311 (Gln-Glu) with Gly-Cys;
c. substitution of amino acid residues 299 (Leu) and 310 (Gln) with Cys and Gly, respectively;
d. substitution of amino acid residues 302-311 (Asp-Arg-Gly-Ser-Asp-Gly-Lys-Leu-Gln-Glu) (SEQ ID NO: 63) with Gly-Gln-Gly-Cys (SEQ ID NO: 64); and e. substitution of amino acid residue 299 (Leu) to Cys and substitution of amino acid residues 302-310 (Asp-Arg-Gly-Ser-Asp-Gly-Lys-Leu-Gln) (SEQ ID NO: 65) with Gly-Gln-Gly.

As used herein, the term "integrin $\alpha_v$ headpiece polypeptide" refers to a polypeptide that is similar or identical to the sequence of a wild-type integrin $\alpha_v$ polypeptide having at least the headpiece thereof (including, e.g., β-propeller and/or thigh domains). In some embodiments, the term "integrin $\alpha_v$ headpiece polypeptide" refers to a polypeptide having an amino acid sequence that is at least 70% or more (including at least 75%, at least 80%, at least 85%, at least 90%, at least 95%, at least 97%, at least 99%, or 100%) identical to that of a wild-type integrin acv polypeptide having at least the headpiece thereof (including, e.g., β-propeller and/or thigh domains), and is capable of interacting with an integrin β subunit to form a heterodimer and retaining (e.g., at least 70% or more of) the biological activity of the wild-type heterodimer, including, but not limited to, ligand-binding, cellular adhesion, migration, invasion, differentiation, proliferation, apoptosis, and/or gene expression. In some embodiments, the term "integrin $\alpha_v$ headpiece polypeptide" refers to a polypeptide that is similar or identical to the sequence of a wild-type integrin $\alpha_v$ headpiece polypeptide (including, e.g., β-propeller and/or thigh domains). In some embodiments, the integrin $\alpha_v$ headpiece polypeptide can further include other domain(s) of a wild-type integrin $\alpha_v$ polypeptide such as calf-1 and/or calf-2 domains that form the lower legs of the wild-type integrin $\alpha_v$ polypeptide. In some embodiments, an integrin $\alpha_v$ headpiece polypeptide refers to a full-length wild-type integrin $\alpha_v$ headpiece polypeptide sequence. In some embodiments, an integrin $\alpha_v$ headpiece polypeptide refers to a functional domain or domains (e.g., β-propeller and/or thigh domains) of an integrin $\alpha_v$ headpiece polypeptide that interacts with an integrin β headpiece polypeptide (as defined herein) to form a heterodimer comprising a ligand-binding site. The wild-type integrin $\alpha_v$ headpiece sequences of various species can be identified from the full-length integrin $\alpha_v$ sequences available on the world wide web from the NCBI, including human (See Table 1 above) and mouse. In one embodiment, the integrin $\alpha_v$ headpiece polypeptide comprises, consists essentially of, or consists of the amino acid sequence of human integrin $\alpha_v$ subunit shown in SEQ ID NO: 1.

In some embodiments, the modified integrin $\alpha_v$ headpiece polypeptide can comprise, consist essentially of, or consist of an amino acid sequence of a human integrin $\alpha_v$ headpiece polypeptide (e.g., of SEQ ID NO: 1) or a functional variant thereof, with at least one Cys residue introduced thereto by substitution of amino acid residues 399-401 (Ser-Met-Pro) with Ser-Cys-Pro (modification (a)(i)). In some embodiments, the modified integrin $\alpha_v$ headpiece polypeptide can comprise, consist essentially of, or consist of an amino acid sequence of an integrin $\alpha_v$ headpiece polypeptide (e.g., of SEQ ID NO: 1) or a functional variant thereof, with at least one Cys residue introduced thereto by substitution of amino acid residues 399-401 (Ser-Met-Pro) with Gly-Cys-Pro (modification (a)(ii)). In some embodiments, the modified integrin $\alpha_v$ headpiece polypeptide can comprise, consist essentially of, or consist of an amino acid sequence of an integrin $\alpha_v$ headpiece polypeptide (e.g., of SEQ ID NO: 1) or a functional variant thereof, with at least one Cys residue introduced thereto by substitution of amino acid residues 399-401 (Ser-Met-Pro) with Ser-Gly-Cys-Pro (SEQ ID NO: 59) (modification (a)(v)).

In some embodiments, the modified integrin $\alpha_v$ headpiece polypeptide can comprise, consist essentially of, or consist of an amino acid sequence of an integrin $\alpha_v$ headpiece polypeptide (e.g., of SEQ ID NO: 1) or a functional variant thereof, with at least two Cys residues introduced thereto by at least two or more of the modifications (a)-(e) as described above. By way of example only, in some embodiments, at least two Cys residues can be introduced into the modified integrin $\alpha_v$ headpiece polypeptide by (1) one of the modifications (a) (i)-(viii) as described above; and (2) at least one of the modifications (b)-(e) as described above.

In some embodiments, the modified integrin α headpiece polypeptides (e.g., modified integrin $\alpha_v$ polypeptides) are soluble polypeptides. The term "soluble" as used herein and throughout the specification generally refers to dissolution of a molecule, e.g., a polypeptide, in a fluid (e.g., a liquid, a solution, and/or a mixture) under a specified condition, e.g., characterized by a number of factors, including, e.g., temperature, pressure, ion concentration, and/or pH. The dissolution can be partial or complete. As used in reference to the modified integrin α and/or β headpiece polypeptides described herein, the term "soluble" refers to complete or partial dissolution of the integrin headpiece polypeptides in an aqueous buffered solution at a specified temperature (e.g., at room temperature). The aqueous buffered solution can further comprise metal ions (e.g., $Ca^{2+}$, $Na^+$ and/or $Mg^{2+}$). Alternatively or additionally, the term "soluble" in reference to modified integrin α and/or β headpiece polypeptides described herein means that the polypeptides are not expressed on cell surface.

In some embodiments, the modified integrin α headpiece polypeptides (e.g., modified integrin $\alpha_v$ headpiece polypeptides) can be isolated or purified. As used herein and throughout the specification, the term "isolated" with respect to a polypeptide or protein means a polypeptide or protein in a form that is relatively free from material such as contaminating molecules, including, e.g., polypeptides, lipids, nucleic acids and other cellular material that is normally is associated with the polypeptide or protein in a cell or that is associated with the polypeptide or protein in a library or in a crude preparation.

The term "purified" as applied to polypeptides or proteins herein refers to a composition comprising a desired polypeptide or protein in at least 50% or more of the total protein components in the composition. In some embodiments, the composition comprises a desired polypeptide or protein in at least 60% or more (including, e.g., at least about 70%, at least about 80%, at least about 90%, at least about 95%, at least about 97%, at least about 99%, or 100%) of the total protein components in the composition. The composition can comprise other non-protein components such as carbohydrates, and/or salts. In some embodiments, the composition can comprise, consist essentially of, or consist of a desirable polypeptide or protein in a buffered solution. For example, the modified integrin α headpiece polypeptides (e.g., modified integrin $\alpha_v$ headpiece polypeptides) can be present in a buffered solution.

In some embodiments, the modified integrin α headpiece polypeptides (e.g., modified integrin $\alpha_v$ headpiece polypeptides) can further comprise a detectable label described herein.

In some embodiments, the modified integrin α headpiece polypeptides (e.g., modified integrin $\alpha_v$ headpiece polypeptides) can be further attached to a solid surface. Depending on the need of desired applications, the solid surface can be made of any material, including, but are not limited to, glass, silicone, cellulose-based materials (e.g., paper), plastics, polymer, and/or any combinations thereof.

Polynucleotides encoding the modified integrin α headpiece polypeptides (e.g., the modified integrin $α_v$ headpiece polypeptides described herein) are also encompassed within the scope of the inventions described herein.

Modified Integrin β Headpiece Polypeptides (e.g., Modified Integrin α Headpiece Polypeptides)

Another aspect provided herein relates to a modified integrin β headpiece polypeptide comprising, consisting essentially of, or consisting of an amino acid sequence of an integrin β headpiece polypeptide or a functional variant thereof, with at least one or more (e.g., at least one, at least two, at least three or more) Cys residues introduced into.

In some embodiments, Cys residue(s) can be introduced into domain(s) of an integrin β headpiece polypeptide that are distal from a ligand-binding site. The modified integrin β headpiece polypeptide can substantially retain the functionality (e.g., ligand-binding capability) of the naturally occurring integrin β headpiece polypeptide (e.g., retain at least about 50%, at least about 60%, at least about 70%, at least about 80%, at least about 90%, at least about 95%, at least about 97%, at least about 99% or more and up to 100%), while having the ability to form a disulfide bond with an integrin α polypeptide or a modified integrin α headpiece polypeptide.

A Cys residue can be introduced into one or more domain(s) of an integrin β headpiece polypeptide by any methods of modifying amino acids known in the art, including, e.g., substitution, deletion and/or addition of an amino acid or amino acid analog. In some embodiments, at least one or more Cys residue or an analog thereof can be introduced into one or more domain(s) of the integrin β headpiece polypeptide by substitution of an amino acid residue, and/or addition of a Cys residue or an analog thereof. In some embodiments, while introducing one or more Cys residue into at least one domain of the integrin β headpiece polypeptide, one or more other amino acid residues present in the integrin β headpiece polypeptide can also be deleted.

As used herein, the term "integrin β headpiece polypeptide" refers to a polypeptide that is similar or identical to the sequence of wild-type integrin β polypeptide having at least the headpiece thereof. An integrin β headpiece polypeptide generally includes a βI domain, a hybrid domain, a PSI (plexin, semaphoring, and integrin) domain, and/or an I-EGF-1 domain, and confers ligand-binding capability upon binding with an appropriate integrin α headpiece polypeptide. An integrin β headpiece polypeptide can be derived from the headpiece of any integrin β polypeptide, including, for example, $β_1$, $β_2$, $β_3$, $β_4$, $β_5$, $β_6$, $β_7$, and $β_8$. In some embodiments, the term "integrin β polypeptide" refers to a polypeptide having an amino acid sequence that is at least 70% or more (including at least 75%, at least 80%, at least 85%, at least 90%, at least 95%, at least 97%, at least 99%, or 100%) identical to that of a wild-type integrin β polypeptide having at least the headpiece thereof (including, e.g., βI, hybrid, PSI and/or I-EGF-1 domains), and is capable of interacting with an integrin α subunit (e.g., a headpiece) to form a heterodimer and retaining (e.g., at least 70% or more of) the biological activity of the wild-type heterodimer, including, but not limited to, ligand binding, cellular adhesion, migration, invasion, differentiation, proliferation, apoptosis, and/or gene expression. In some embodiments, the term "integrin β headpiece polypeptide" refers to a polypeptide that is similar or identical to the sequence of a wild-type integrin β headpiece polypeptide (including, e.g., βI, hybrid, PSI and/or I-EGF-1 domains). In some embodiments, the integrin β headpiece polypeptide can further include other domain(s) of a wild-type integrin β polypeptide such as I-EGF-2 to I-EGF-4 and/or β tail domains that form the lower legs of the wild-type integrin β polypeptide. In some embodiments, an integrin β headpiece polypeptide refers to a full-length wild-type integrin β headpiece polypeptide sequence. In some embodiments, an integrin β headpiece polypeptide refers to a functional domain or domains of an integrin β headpiece polypeptide that interacts with an integrin α headpiece polypeptide to form a heterodimer comprising a ligand-binding site. The wild-type integrin β polypeptide sequences (comprising the ligand-binding headpiece and other domains that form the lower leg, including, e.g., I-EGF-2 to I-EGF-4 and/or 3 tail domains) of various species are available on the world wide web from the NCBI, including human and mouse. For example, the amino acid sequences of human integrin β polypeptides and the corresponding nucleotide sequences encoding the integrin β polypeptides are available at NCBI under GI numbers shown in Table 2 below. A skilled artisan can identify an integrin β headpiece sequence from the corresponding integrin β polypeptide/polynucleotide sequence, based on the known locations of, e.g., β1 domain, and/or ligand-binding sites, within the sequence.

TABLE 2

Sequences of human integrin β polypeptides

| Human integrin β polypeptide | Amino acid sequence (GI number) | Nucleotide sequence (GI number) |
| --- | --- | --- |
| $β_1$ | 218563324 (SEQ ID NO: 43) | 182519230 (SEQ ID NO: 51) |
| $β_2$ | 825636 (SEQ ID NO: 44) | 186508 (SEQ ID NO: 52) |
| $β_3$ | 119578086 (SEQ ID NO: 45) | 118341516 (SEQ ID NO: 53) |
| $β_4$ | 33951 (SEQ ID NO: 46) | 33950 (SEQ ID NO: 54) |
| $β_5$ | 306894 (SEQ ID NO: 47) | 184524 (SEQ ID NO: 55) |
| $β_6$ | 119631795 (SEQ ID NO: 48) | 115527926 (SEQ ID NO: 56) |
| $β_7$ | 186511 (SEQ ID NO: 49) | 186510 (SEQ ID NO: 57) |
| $β_8$ | 184521 (SEQ ID NO: 50) | 184520 (SEQ ID NO: 58) |

In some embodiments, a modified integrin β headpiece polypeptide comprises, consists essentially of, or consists of an amino acid sequence of an integrin $β_6$ headpiece polypeptide or a functional variant thereof, with at least one Cys residue introduced into.

Accordingly, in one aspect, provided herein is a modified integrin $β_6$ headpiece polypeptide. The modified integrin $β_6$ headpiece polypeptide comprises, consists essentially of, or consists of an amino acid sequence of an integrin $β_6$ headpiece polypeptide (SEQ ID NO: 2) or a functional variant thereof, with at least one or more (e.g., at least one, at least two, at least three or more) Cys residues introduced thereto by one, two or all three of the following modifications (f)-(h):

f. substitution of amino acid residue 270 (Ile) with Cys;
g. substitution of amino acid residue 294 (Thr) with Cys; and
h. substitution of amino acid residue 296 (Gly) with Cys.

As used herein, the term "integrin $\beta_6$ headpiece polypeptide" refers to a polypeptide that is similar or identical to the sequence of wild-type integrin $\beta_6$ headpiece polypeptide having at least the headpiece thereof (including, e.g., $\beta$I, hybrid, PSI, and/or I-EGF-1 domains). In some embodiments, the term "integrin $\beta_6$ headpiece polypeptide" refers to a polypeptide having an amino acid sequence that is at least 70% or more (including at least 75%, at least 80%, at least 85%, at least 90%, at least 95%, at least 97%, at least 99%, or 100%) identical to that of a wild-type integrin $\beta_6$ headpiece polypeptide (including, e.g., $\beta$I, hybrid, PSI, and/or I-EGF-1 domains), and is capable of interacting with an integrin $\alpha$ headpiece polypeptide to form a heterodimer and retaining (e.g., at least 70% or more of) the biological activity of the wild-type heterodimer, including, but not limited to, ligand binding, cellular adhesion, migration, invasion, differentiation, proliferation, apoptosis, and/or gene expression. In some embodiments, the term "integrin $\beta_6$ headpiece polypeptide" refers to a polypeptide that is similar or identical to the sequence of a wild-type integrin $\beta_6$ headpiece polypeptide (including, e.g., $\beta$I, hybrid, PSI, and/or I-EGF-1 domains). In some embodiments, the integrin $\beta_6$ headpiece polypeptide can further include other domain(s) of a wild-type integrin $\alpha_v$ polypeptide such as I-EGF-2, I-EGF-3, I-EGF-4, and/or $\beta$ tail domains that form the lower legs of the wild-type integrin $\beta_6$ polypeptide. In some embodiments, an integrin $\beta_6$ polypeptide refers to a full-length wild-type integrin $\beta_6$ polypeptide sequence. In some embodiments, an integrin $\beta_6$ headpiece polypeptide refers to a functional domain or domains of an integrin $\beta_6$ headpiece polypeptide that interacts with an integrin $\alpha$ headpiece polypeptide to form a heterodimer comprising a ligand-binding site. The wild-type integrin $\beta_6$ headpiece sequences of various species can be identified from the full-length integrin $\beta_6$ sequences available on the world wide web from the NCBI, including human (see Table 2 above) and mouse. In one embodiment, the integrin $\beta_6$ headpiece polypeptide comprises, consists essentially of, or consists of the amino acid sequence of human integrin $\beta_6$ headpiece polypeptide shown in SEQ ID NO:2.

In some aspects, provided herein are fragments of the modified integrin $\beta_6$ headpiece polypeptides described herein. In one aspect, the integrin $\beta_6$ headpiece polypeptide fragment comprises, consists essentially of, or consists of a $\beta$I domain of integrin $\beta_6$ subunit with at least one Cys residue introduced thereto by one, two, or all of the following modifications (f)-(h), the $\beta$I domain is defined from residues DYP to residues ELR as shown in an amino acid sequence of SEQ ID NO: 2, or a functional variant thereof.

(f) substitution of amino acid residue 270 (Ile) with Cys;
(g) substitution of amino acid residue 294 (Thr) with Cys; and
(h) substitution of amino acid residue 296 (Gly) with Cys.

In another aspect, the integrin $\beta_6$ headpiece polypeptide fragment comprises, consists essentially of, or consists of a $\beta$I domain and a hybrid domain of integrin $\beta_6$ subunit, the $\beta$I domain being defined from residues DYP to residues ELR as shown in an amino acid sequence of SEQ ID NO: 2, or a functional variant thereof, while the hybrid domain being defined from residues ENP to residues QTE, and/or from residues SEV to residues ECN as shown in an amino acid sequence of SEQ ID NO: 2, or a functional variant thereof; wherein at least one least one Cys residue is introduced to the $\beta$I domain by one, two, or all of the following modifications (f)-(h):

(f) substitution of amino acid residue 270 (Ile) with Cys;
(g) substitution of amino acid residue 294 (Thr) with Cys; and
(h) substitution of amino acid residue 296 (Gly) with Cys.

In yet another aspect, the integrin $\beta_6$ headpiece polypeptide fragment comprises, consists essentially of, or consists of a $\beta$I domain, a hybrid domain, and a PSI domain of integrin $\beta_6$ subunit, the $\beta$I domain being defined from residues DYP to residues ELR as shown in an amino acid sequence of SEQ ID NO: 2, or a functional variant thereof, while the hybrid domain being defined from residues ENP to residues QTE, and/or from residues SEV to residues ECN as shown in an amino acid sequence of SEQ ID NO: 2, or a functional variant thereof; and the PSI domain being defined from from residues HVQ to residues NFI as shown in an amino acid sequence of SEQ ID NO: 2; wherein at least one least one Cys residue is introduced to the $\beta$I domain by one, two, or all of the following modifications (f)-(h):

(f) substitution of amino acid residue 270 (Ile) with Cys;
(g) substitution of amino acid residue 294 (Thr) with Cys; and
(h) substitution of amino acid residue 296 (Gly) with Cys.

The modified integrin $\beta_6$ headpiece polypeptide fragments of various aspects described herein can be isolated. The modified integrin $\beta_6$ headpiece polypeptide fragments of various aspects described herein can further be attached to a solid surface.

In some embodiments, the modified integrin $\beta_6$ headpiece polypeptide fragments of various aspects described herein are soluble polypeptides.

In another aspect, provided herein is a modified integrin $\beta$ headpiece polypeptide. The integrin $\beta_3$ headpiece polypeptide comprises, essentially consist of, or consist of amino acid residues 27 to 498 of SEQ ID NO: 5 or a functional fragment thereof (e.g., with desired domain(s)) with at least one Cys residue introduced thereto by substitution of amino acid residue 293 (Gln) with Cys. The modified integrin $\beta_3$ headpiece polypeptide can be isolated. The modified integrin $\beta_3$ headpiece polypeptide can further be attached to a solid surface.

In another aspect, provided herein is a modified integrin $\beta_8$ headpiece polypeptide. The integrin $\beta_8$ headpiece polypeptide comprises, essentially consist of, or consist of amino acid residues 43 to 498 of SEQ ID NO: 6 or a functional fragment thereof (e.g., with desired domain(s)) with at least one Cys residue introduced thereto by substitution of amino acid residue 301 (Val) with Cys. The modified integrin $\beta_8$ headpiece polypeptide can be isolated. The modified integrin $\beta_8$ headpiece polypeptide can further be attached to a solid surface.

In some embodiments, the modified integrin $\beta_6$ headpiece polypeptide can comprise, consist essentially of, or consist of an amino acid sequence of an integrin $\beta_6$ headpiece polypeptide (SEQ ID NO: 2) or a functional variant thereof (e.g., with desired domain(s)), with at least one Cys residue introduced thereto by substitution of amino acid residue 270 (Ile) with Cys (modification (f)).

In some embodiments, the modified integrin $\beta_6$ headpiece polypeptide can comprise, consist essentially of, or consist of an amino acid sequence of an integrin $\beta_6$ headpiece polypeptide (SEQ ID NO: 2) or a functional variant thereof, with at least two Cys residues introduced thereto by at least two or more of the modifications (f)-(h) as described above. By way of example only, in some embodiments, at least two Cys residues can be introduced into the modified integrin $\beta_6$ headpiece polypeptide by any two of the modifications (f)-(h) as described above.

In some embodiments, the modified integrin $\beta$ headpiece polypeptides (e.g., modified integrin $\beta_6$ polypeptides) are soluble polypeptides.

In various embodiments, the modified integrin $\beta$ headpiece polypeptides (e.g., $\beta_6$ headpiece polypeptides) can be isolated or purified. In some embodiments, the modified integrin $\beta$ headpiece polypeptides (e.g., $\beta_6$ headpiece polypeptides) can be present in a buffered solution.

In some embodiments, the modified integrin $\beta$ headpiece polypeptides (e.g., $\beta_6$ headpiece polypeptides) can further comprise a detectable label described herein.

In various embodiments, the modified integrin $\beta$ headpiece polypeptides (e.g., $\beta_6$ headpiece polypeptides) or functional variants/fragments thereof can be further attached to a solid surface. Depending on the need of desired applications, the solid surface can be made of any material, including, but are not limited to, glass, silicone, cellulose-based materials (e.g., paper), plastics, polymer, and/or any combinations thereof.

Polynucleotides encoding the modified integrin $\beta$ headpiece polypeptides (e.g., the modified integrin $\beta_6$ headpiece polypeptides described herein) or functional variants/fragments thereof are also encompassed within the scope of the inventions described herein.

Modified Integrin Polypeptide Dimers or Functional Fragments/Variants Thereof

Modified integrin polypeptide dimers comprising at least one of the modified integrin $\alpha$ headpiece polypeptide and the modified integrin $\beta$ headpiece polypeptide are also provided herein. In accordance with some aspects described herein, the modified integrin polypeptide dimers comprise at least one or more (e.g., at least one, at least two, at least three or more) disulfide bonds linking the two integrin $\alpha$ and $\beta$ headpiece subunits or functional variants/fragments thereof. The modified integrin polypeptide dimers described herein can still interact with a natural ligand as it binds to a naturally occurring integrin heterodimer, but, unlike naturally occurring integrin heterodimers that can reversibly dissociate, these modified polypeptide dimers described herein do not dissociate and enable formation of a crystallizable structure of an integrin heterodimer, alone or complexed with a test ligand, via formation of a disulfide bridge between the two integrin subunits.

One aspect of the modified integrin polypeptide dimers provided herein relates to a modified integrin polypeptide dimer comprising, consisting essentially of, or consisting of a modified integrin $\alpha$ headpiece polypeptide described herein, and an integrin $\beta$ headpiece polypeptide, wherein the modified integrin $\alpha$ polypeptide and the integrin $\beta$ headpiece polypeptide are covalently linked by at least one (e.g., at least one, at least two, at least three or more) disulfide bonds. Generally, the integrin $\alpha$ polypeptide can comprise, essentially of, or consist of a $\beta$-propeller domain and a thigh domain. In some embodiments, the integrin $\beta$ polypeptide can comprise, essentially consist of, or consist of a $\beta$I domain. In some embodiments, the integrin $\beta$ polypeptide can comprise, essentially consist of, or consist of a $\beta$I domain and a hybrid domain. In some embodiments, the integrin $\beta$ polypeptide can comprise, essentially consist of, or consist of a $\beta$I domain, a hybrid domain, and a PSI domain.

As described above, the modified integrin $\alpha$ headpiece polypeptide comprises, consists essentially of, or consists of an amino acid sequence of an integrin $\alpha$ headpiece polypeptide (including, e.g., $\beta$-propeller and/or thigh domains), with at least one or more (e.g., at least one, at least two or more) Cys residues introduced thereto. The integrin $\alpha$ headpiece polypeptide can be derived from the headpiece of the corresponding integrin $\alpha$ polypeptide selected from the group consisting of $\alpha_1$, $\alpha_2$, $\alpha_3$, $\alpha_4$, $\alpha_5$, $\alpha_6$, $\alpha_7$, $\alpha_8$, $\alpha_9$, $\alpha_{10}$, $\alpha_{11}$, $\alpha_D$, $\alpha_E$, $\alpha_L$, $\alpha_M$, $\alpha_\nu$, $\alpha_{2B}$, and $\alpha_X$) or a functional variant thereof.

In some embodiments, the modified integrin $\alpha$ headpiece polypeptide is a modified integrin $\alpha_\nu$ headpiece polypeptide described herein. In some embodiments, the modified integrin $\alpha_\nu$ headpiece polypeptide can comprise, consist essentially of, or consist of a substitution of amino acid residues 399-401 (Ser-Met-Pro) with Ser-Cys-Pro (modification (a) (i)). In some embodiments, the modified integrin $\alpha_\nu$ headpiece polypeptide can comprise, consist essentially of, or consist of a substitution of amino acid residues 399-401 (Ser-Met-Pro) with Gly-Cys-Pro (modification (a) (ii)). In some embodiments, the modified integrin $\alpha_\nu$ headpiece polypeptide can comprise, consist essentially of, or consist of a substitution of amino acid residues 399-401 (Ser-Met-Pro) with Ser-Gly-Cys-Pro (SEQ ID NO: 59) (modification (a) (v)).

In various embodiments, the integrin $\beta$ headpiece polypeptide covalently linked to a modified integrin $\alpha$ headpiece polypeptide described herein (e.g., a modified integrin $\alpha_\nu$ headpiece polypeptide described herein) can be derived from the full-length integrin $\beta$ polypeptide selected from the group consisting of $\beta_1$, $\beta_2$, $\beta_3$, $\beta_4$, $\beta_5$, $\beta_6$, $\beta_7$, and $\beta_8$.

Another aspect of the modified integrin polypeptide dimers provided herein relates to a modified integrin polypeptide dimer comprising, consisting essentially of, or consisting of an integrin $\alpha$ headpiece polypeptide, and a modified integrin $\beta$ headpiece polypeptide described herein or a modified integrin $\beta$ headpiece polypeptide fragment (e.g., with desired domain(s)) described herein, wherein the integrin $\alpha$ headpiece polypeptide and the modified integrin $\beta$ headpiece polypeptide are covalently linked by at least one (e.g., at least one, at least two, at least three or more) disulfide bonds.

As described above, the modified integrin $\beta$ headpiece polypeptide comprises, consists essentially of, or consists of an amino acid sequence of an integrin $\beta$ headpiece polypeptide, with at least one or more (e.g., at least one, at least two or more) Cys residues introduced thereto. The integrin $\beta$ headpiece polypeptide can be derived from the headpiece of the corresponding integrin $\beta$ polypeptide selected from the group consisting of $\beta_1$, $\beta_2$, $\beta$, $\beta_4$, $\beta_5$, $\beta_6$, $\beta_7$, and $\beta_8$) or a functional variant thereof.

In some embodiments, the modified integrin $\beta$ polypeptide is a modified integrin $\beta_6$ headpiece polypeptide described herein or a functional variant thereof (e.g., a $\beta$I domain alone, or in combination with a hybrid domain and/or a PSI domain). In some embodiments, the modified integrin $\beta_6$ headpiece polypeptide or a functional variant thereof can comprise, consist essentially of, or consist of a substitution of amino acid residue 270 (Ile) with Cys (modification (f)). It should be noted that numbering is based on SEQ ID NO: 2, which is the amino acid sequence of the $\beta_6$ full headpiece. One of skill in the art can adjust the numbering of the corresponding cysteine substitution, e.g., when only a $\beta$I domain is used.

In some embodiments, the modified integrin $\beta$ headpiece polypeptide is a modified integrin $\beta_3$ headpiece polypeptide described herein or a functional variant thereof (e.g., a βI domain alone, or in combination with a hybrid domain and/or a PSI domain). In some embodiments, the modified integrin $β_3$ headpiece polypeptide or a functional variant thereof can comprise, consist essentially of, or consist of a substitution of amino acid residue 293 (Gln) with Cys. It should be noted that numbering is based on SEQ ID NO: 5, which is the amino acid sequence of the $β_3$ full headpiece. One of skill in the art can adjust the numbering of the corresponding cysteine substitution, e.g., when only a βI domain is used.

In some embodiments, the modified integrin β headpiece polypeptide is a modified integrin $β_8$ headpiece polypeptide described herein or a functional variant thereof (e.g., a βI domain alone, or in combination with a hybrid domain and/or a PSI domain). In some embodiments, the modified integrin $β_8$ headpiece polypeptide or a functional variant thereof can comprise, consist essentially of, or consist of a substitution of amino acid residue 301 (Val) with Cys. It should be noted that numbering is based on SEQ ID NO: 6, which is the amino acid sequence of the $β_8$ full headpiece. One of skill in the art can adjust the numbering of the corresponding cysteine substitution, e.g., when only a βI domain is used.

In some embodiments, the integrin α headpiece polypeptide covalently linked to the modified integrin β headpiece polypeptide can be derived from the headpiece of the corresponding integrin α polypeptide selected from the group consisting of $α_1$, $α_2$, $α_3$, $α_4$, $α_5$, $α_6$, $α_7$, $a_8$, $α_9$, $α_{10}$, $α_{11}$, $α_D$, $α_E$, $α_L$, $α_M$, $α_v$, $α_{2B}$, and $α_X$. In some embodiments where the modified integrin β polypeptide is a modified integrin $β_6$ headpiece polypeptide described herein, the integrin α headpiece polypeptide covalently linked to the modified integrin $β_6$ headpiece polypeptide is derived from the headpiece of the integrin $α_v$ polypeptide.

A further aspect of the modified integrin polypeptide dimers provided herein relates to a modified integrin polypeptide dimer comprising, consisting essentially of, or consisting of a modified integrin α headpiece polypeptide described herein or a functional variant thereof, and a modified integrin β headpiece polypeptide described herein or a functional variant thereof, wherein the modified integrin α headpiece polypeptide or a functional variant thereof and the modified integrin β headpiece polypeptide or a functional variant thereof are covalently linked by at least one (e.g., at least one, at least two, at least three or more) disulfide bonds.

The modified integrin α headpiece polypeptide or a functional variant thereof comprises, consists essentially of, or consists of an amino acid sequence of an integrin α headpiece polypeptide (for example, the headpiece of one of the integrin α polypeptide selected from the group consisting of $α_1$, $α_2$, $α_3$, $α_4$, $α_5$, $α_6$, $α_7$, $α_8$, $α_9$, $α_{10}$, $α_{11}$, $α_D$, $α_E$, $α_L$, $α_M$, $α_v$, $α_{2B}$, and $α_X$) or a functional variant thereof, with at least one or more (e.g., at least one, at least two or more) Cys residues introduced thereto; while the modified integrin β headpiece polypeptide comprises, consists essentially of, or consists of an amino acid sequence of an integrin β headpiece polypeptide (for example, the headpiece of one of the integrin β polypeptide selected from the group consisting of $β_1$, $β_2$, $β_3$, $β_4$, $β_5$, $β_6$, $β_7$, and $β_8$) or a functional variant thereof, with at least one or more (e.g., at least one, at least two or more) Cys residues introduced thereto.

In one aspect, provided herein is a modified integrin polypeptide dimer comprising, consisting essentially of, or consisting of a modified integrin $α_5$ headpiece polypeptide and a modified integrin $β_1$ headpiece polypeptide covalently linked together by at least one or more disulfide bond. In one embodiment, the modified integrin $α_5$ headpiece polypeptide comprises, consists essentially of, or consists of an amino acid sequence of an integrin $α_5$ headpiece polypeptide (e.g., SEQ ID NO: 3) with at least one Cys residue introduced thereby by substitution of amino acid residue 452 (Thr) with Cys. (SEQ ID NO: 3 includes the signal peptide sequence at positions 1-41. Without the signal peptide sequence, the numbering of the amino acid residue Thr being substituted with Cys would become amino acid residue 411). In one embodiment, the modified integrin $β_1$ headpiece polypeptide comprises, consists essentially of, or consists of one, two, three, or all domains of an integrin $β_1$ headpiece polypeptide (e.g., SEQ ID NO: 4) selected from the group consisting of a PSI domain, hybrid domain, βI domain, and an EGF-1 domain, with at least one Cys residue introduced thereby by substitution of amino acid residue 295 (Leu) with Cys. (SEQ ID NO: 4 includes the signal peptide sequence at positions 1-20. Without the signal peptide sequence, the numbering of the amino acid residue Leu being substituted with Cys would become amino acid residue 275).

In one aspect, a modified integrin polypeptide dimer comprising, consisting essentially of, or consisting of a modified integrin $α_v$ headpiece polypeptide described herein and a modified integrin $β_3$ headpiece polypeptide covalently linked together by at least one disulfide bond is also provided herein. In one embodiment, the modified integrin $β_3$ headpiece polypeptide comprises, consists essentially of, or consists of one, two, three, or all domains of an integrin $β_3$ headpiece polypeptide (e.g., SEQ ID NO: 5) selected from the group consisting of a PSI domain, hybrid domain, βI domain, and an EGF-1 domain, with at least one Cys residue introduced thereby by substitution of amino acid residue 293 (Gln) with Cys. (SEQ ID NO: 5 includes the signal peptide sequence at positions 1-26. Without the signal peptide sequence, the numbering of the amino acid residue Gln being substituted with Cys would become amino acid residue 267).

One aspect provided herein relates to a modified integrin polypeptide dimer comprising, consisting essentially of, or consisting of a modified integrin $α_v$ headpiece polypeptide described herein and a modified integrin $β_8$ headpiece polypeptide covalently linked together by at least one disulfide bond. In one embodiment, the modified integrin $β_8$ headpiece polypeptide comprises, consists essentially of, or consists of one, two, three, or all domains of an integrin $β_8$ headpiece polypeptide (e.g., SEQ ID NO: 6) selected from the group consisting of a PSI domain, hybrid domain, βI domain, and an EGF-1 domain, with at least one Cys residue introduced thereby by substitution of amino acid residue 301 (Val) with Cys. (SEQ ID NO: 6 includes the signal peptide sequence at positions 1-42. Without the signal peptide sequence, the numbering of the amino acid residue Val being substituted with Cys would become amino acid residue 259).

A further aspect provides a modified integrin polypeptide dimer comprising, consisting essentially of, or consisting of a modified integrin $α_v$ headpiece polypeptide described herein and a modified integrin $β_6$ headpiece polypeptide covalently linked together by at least one disulfide bond. The modified integrin polypeptide dimer comprises, consists essentially of, or consists of (i) an integrin $α_v$ headpiece polypeptide or a functional variant thereof, with at least one or more (e.g., at least one, at least two or more) Cys residues introduced thereto; and (ii) an integrin $β_6$ headpiece polypeptide or a functional variant thereof, with at least one or more (e.g., at least one, at least two or more) Cys residues introduced thereto.

Table 3 below lists some embodiments of the modified integrin polypeptide dimers described herein comprising, consisting essentially of, or consisting of a modified integrin $\alpha_v$ headpiece polypeptide described herein and a modified integrin $\beta_6$ headpiece polypeptide described herein. By way of example only, as shown in Table 3, any one of the modified integrin $\alpha_v$ headpiece polypeptide (comprising, consisting essentially of, or consisting of at least one modification (a) (i) to (c)) can form a modified integrin polypeptide dimer with one of the modified integrin $\beta_6$ headpiece polypeptides (selected from modifications (f) to (h)) as indicated by a "x" symbol in the table. In some embodiments, a modified integrin $\alpha_v$ headpiece polypeptide comprising at least two modifications selected from (a) (i) to (c) provided that there is no overlap in the modifications can form a modified integrin polypeptide dimer with at least one or more (e.g., at least one, at least two or more) of the modified integrin β6 headpiece polypeptides (selected from modifications (f) to (h)).

In one aspect, provided herein is a modified integrin polypeptide dimer comprising, consisting essentially of, or consisting of a modified integrin $\alpha_v$ headpiece polypeptide and a modified integrin $\beta_6$ headpiece polypeptide covalently linked together by at least one or more disulfide bonds, wherein:

the modified integrin $\alpha_v$ headpiece polypeptide comprises, consists essentially of, or consists of an amino acid sequence of an integrin $\alpha_v$ polypeptide (SEQ ID NO: 1) or a functional variant thereof, with at least one Cys residue introduced thereto by substitution of amino acid residues 399-401 (Ser-Met-Pro) with Ser-Cys-Pro (modification (a) (i)); and the modified integrin $\beta_6$ headpiece polypeptide comprises, consists essentially of, or consists of an amino acid sequence of an integrin $\beta_6$ polypeptide (SEQ ID NO: 2) or a functional variant thereof, with at least one Cys residue introduced thereto by substitution of amino acid residue 270 (Ile) with Cys (modification (f)).

In one aspect, provided herein is a modified integrin polypeptide dimer comprising, consisting essentially of, or consisting of a modified integrin $\alpha_v$ headpiece polypeptide

TABLE 3

Exemplary combinations of the modified integrin polypeptide dimers described herein comprising, consisting essentially of, or consisting of a modified integrin $\alpha_v$ headpiece polypeptide described herein and a modified integrin $\beta_6$ headpiece polypeptide described herein. Table discloses SEQ ID NOS 60-65, respectively, in order of appearance.

| | | | Based on SEQ ID NO: 2 | | |
|---|---|---|---|---|---|
| | | Modifications | f<br>Substitution of amino acid residue 270 (Ile) with Cys | g<br>Substitution of amino acid residue 294 (Thr) with Cys | h<br>Substitution of amino acid residue 296 (Gly) with Cys |
| SEQ ID NO: 1 | a (i) | Substitution of amino acid residues 399-401 (Ser-Met-Pro) with Ser-Cys-Pro | x | x | x |
| | a (ii) | Substitution of amino acid residues 399-401 (Ser-Met-Pro) with Gly-Cys-Pro | x | x | x |
| | a (iii) | Substitution of amino acid residues 399-401 (Ser-Met-Pro) with Ser-Cys-Gly | x | x | x |
| | a (iv) | Substitution of amino acid residues 399-401 (Ser-Met-Pro) with Gly-Cys-Gly | x | x | x |
| | a (v) | Substitution of amino acid residues 399-401 (Ser-Met-Pro) with Ser-Gly-Cys-Pro | x | x | x |
| | a (vi) | Substitution of amino acid residues 399-401 (Ser-Met-Pro) with Ser-Cys-Gly-Pro | x | x | x |
| | a (vii) | Substitution of amino acid residues 399-401 (Ser-Met-Pro) with Gly-Cys-Gly-Pro | x | x | x |
| | a (viii) | Substitution of amino acid residues 399-401 (Ser-Met-Pro) with Ser-Gly-Cys-Gly | x | x | x |
| | b | Substitution of amino acid residues 310-311 (Gln-Glu) with Gly-Cys | x | x | x |
| | c | Substitution of amino acid residues 299 (Leu) and 310 (Gln) with Cys and Gly, respectively | x | x | x |
| | d | Substitution of amino acid residues 302-311 (Asp-Arg-Gly-Ser-Asp-Gly-Lys-Leu-Gln-Glu) with Gly-Gln-Gly-Cys | x | x | x |
| | e | Substitution of amino acid residue 299 (Leu) to Cys and Substitution of amino acid residues 302-310 (Asp-Arg-Gly-Ser-Asp-Gly-Lys-Leu-Gln) with Gly-Gln-Gly | x | x | x | and a modified integrin $\beta_6$ headpiece polypeptide covalently linked together by at least one or more disulfide bonds, wherein:

the modified integrin $\alpha_v$ headpiece polypeptide comprises, consists essentially of, or consists of an amino acid sequence of an integrin $\alpha_v$ headpiece polypeptide (SEQ ID NO: 1) or a functional variant thereof, with at least one Cys residue introduced thereto by substitution of amino acid residues 399-401 (Ser-Met-Pro) with Gly-Cys-Pro (modification (a)(ii)); and the modified integrin $\beta_6$ headpiece polypeptide comprises, consists essentially of, or consists of an amino acid sequence of an integrin $\beta_6$ headpiece polypeptide (SEQ ID NO: 2) or a functional variant thereof, with at least one Cys residue introduced thereto by substitution of amino acid residue 270 (Ile) with Cys (modification (f)).

In one aspect, provided herein is a modified integrin polypeptide dimer comprising, consisting essentially of, or consisting of a modified integrin $\alpha_v$ headpiece polypeptide and a modified integrin $\beta_6$ headpiece polypeptide covalently linked together by at least one or more disulfide bonds, wherein:

the modified integrin $\alpha_v$ headpiece polypeptide comprises, consists essentially of, or consists of an amino acid sequence of an integrin $\alpha_v$ headpiece polypeptide (SEQ ID NO: 1) or a functional variant thereof, with at least one Cys residue introduced thereto by substitution of amino acid residues 399-401 (Ser-Met-Pro) with Ser-Gly-Cys-Pro (SEQ ID NO: 59) (modification (a)(v)); and the modified integrin $\beta_6$ headpiece polypeptide comprises, consists essentially of, or consists of an amino acid sequence of an integrin $\beta_6$ headpiece polypeptide (SEQ ID NO: 2) or a functional variant thereof, with at least one Cys residue introduced thereto by substitution of amino acid residue 270 (Ile) with Cys (modification (f)).

In some embodiments of various aspects described herein, the modified integrin polypeptide dimer can be soluble polypeptide dimer.

In some embodiments of various aspects described herein, the modified integrin polypeptide dimer can be isolated or purified. In some embodiments, the modified integrin polypeptide dimer (e.g., modified integrin $\alpha_v\beta_6$ polypeptide dimer) can be present in a buffered solution.

In some embodiments of various aspects described herein, the modified integrin polypeptide dimer can further comprise a detectable label described herein.

The modified integrin polypeptide dimer can further be attached to a solid surface. Depending on the need of desired applications, the solid surface can be made of any material, including, but not limited to, glass, silicone, cellulose-based materials (e.g., paper), plastics, polymer, and/or any combinations thereof.

Exemplary Methods of Using the Modified Integrin $\alpha$ and/or $\beta$ Headpiece Polypeptides or Modified Integrin Polypeptide Dimers Described Herein The modified integrin $\alpha$ headpiece polypeptides described herein, the modified integrin $\beta$ headpiece polypeptides described herein, and the modified integrin polypeptide dimers described herein can still interact with a natural ligand as it binds to a naturally occurring integrin heterodimer, but, unlike naturally occurring integrin heterodimers that can reversibly dissociate, the modified integrin polypeptide dimers described herein do not dissociate and enable formation of a crystallizable structure of an integrin heterodimer, alone or complexed with a test ligand, via formation of a disulfide bridge between the two integrin subunits. Accordingly, in some aspects, the compositions as described herein can be used to characterize an integrin-ligand interaction, e.g., to measure the binding affinity of a test agent to an integrin heterodimer (e.g., integrin $\alpha_v\beta_6$ heterodimer); and/or to identify a novel integrin ligand, e.g., in a drug discovery process.

For example, a method for determining whether a test agent forms a complex with an integrin heterodimer is provided herein. The method comprises contacting one or more of the modified integrin polypeptide dimers described herein with a test agent, and detecting formation of a complex comprising the modified integrin polypeptide dimer and the test agent bound thereto. Detection of a formed complex comprising the modified integrin polypeptide dimer and the test agent bound thereto indicates that the test agent is capable of forming a complex with the integrin.

Various methods known in the art can be used to detect formation of a complex comprising the modified integrin polypeptide dimer and a test agent bound thereto. By way of example only, in some embodiments, the complex can be detected by a detection method comprising crystallization of the complex. As used herein, the term "crystallization" refers to the process of formation of a crystal. In some embodiments, the term "crystallization" refers to the process of formation of a protein crystal. The quality of protein crystallization can vary with a number of factors including, e.g., sensitivity of protein samples to temperature, pH, ionic strength, and other factors. Determination of appropriate crystallization conditions for a given protein often requires empirical testing of various conditions. Various methods of protein crystallization are known in the art and can be used in the methods described to cystallize the complex. Exemplary methods of protein crystallization include, but are not limited to vapor diffusion, microbatch, microdialysis (via a semi-permeable membrane, across which small molecules and ions can pass, while proteins and large polymers cannot pass), free-interface diffusion, and any combinations thereof.

In some embodiments, the test agent can further comprise a detectable label. Examples of a detectable label include, but are not limited to, biotin, a fluorescent dye or molecule, a luminescent or bioluminescent marker, a radiolabel, an enzyme, a quantum dot, an imaging agent, or any combination thereof. Methods for detecting various types of the detectable labels are known in the art. For example, where the detectable label comprises a fluorescent molecule, signals from the fluorescent labels can be detected, e.g., by fluorescence anisotropy and/or flow cytometry.

In some embodiments, instead of directly detecting a test agent bound to the modified integrin polypeptide dimer, binding of the test agent to the modified integrin polypeptide dimer can also be determined by an indirect method, e.g., a competition binding assay. In a competition binding assay, the method can further comprise, prior to the detecting, contacting the modified integrin polypeptide dimer with a competing agent.

A competing agent is an agent capable of competing with a test agent to bind the modified integrin polypeptide dimer. Accordingly, a competing agent can be a protein, a peptide, an antibody, a nucleic acid molecule, an apatmer, a peptidomimetic, a small molecule, or any combinations thereof. In some embodiments, the competing agent can be a competing peptide. Since the modified integrin polypeptide dimer is crystallizable, the binding domain of the integrin polypeptide dimer can be readily identified using any methods known in the art, e.g., X-ray crystallography. Based on the binding domain of the dimer, one can design a competing agent that can bind to the binding domain. For example, an exemplary competing peptide for binding to a modified $\alpha_v\beta_6$ polypeptide dimer described herein comprises an amino acid sequence of $X_3$-Arg-Gly-Asp-Leu-$X_1$-$X_2$-Leu (SEQ ID NO: 66), wherein $X_1$, $X_2$, and $X_3$ are each independently an amino acid molecule. Alternatively, another exemplary competing peptide for binding to a modified $\alpha_v\beta_6$ polypeptide dimer described herein comprises an amino acid sequence of $X_3$-Arg-Gly-Asp-Leu-$X_1$-$X_2$-Ile (SEQ ID NO: 67), wherein $X_1$, $X_2$, and $X_3$ are each independently an amino acid molecule.

As used herein, the term "amino acid molecule" encompasses a naturally occurring amino acid molecule, and a non-naturally occurring amino acid molecule. One of skill in the art would know that this definition includes, D- and L-amino acids; alpha-, beta- and gamma-amino acids; chemically modified amino acids; naturally occurring non-proteinogenic amino acids; rare amino acids; and chemically synthesized compounds that have properties known in the art to be characteristic of an amino acid. Additionally, each embodiment can include any combinations of the groups.

The term "naturally occurring amino acid molecule" generally refers to an amino acid molecule that occurs in nature. A naturally occurring amino acid molecule can be a proteinogenic or non-proteinogenic amino acid. The term "proteinogenic amino acid" as used herein refers to one of the twenty amino acids used for protein biosynthesis as well as other amino acids that can be incorporated into proteins during translation (including pyrrolysine and selenocysteine). The twenty proteinogenic amino acids include glycine, alanine, valine, leucine, isoleucine, aspartic acid, glutamic acid, serine, threonine, glutamine, asparagine, arginine, lysine, proline, phenylalanine, tyrosine, tryptophan, cysteine, methionine and histidine. The term "non-proteinogenic amino acid" as used herein refers to an amino acid that is not encoded by the standard genetic code, or incorporated into proteins during translation. In some embodiments, the non-proteinogenic amino acid can result from posttranslational modification of proteins. Exemplary naturally occurring non-proteinogenic amino acids include, but are not limited to, hydroxyproline and selenomethionine.

The term "non-naturally occurring amino acid molecule" as used herein refers to an amino acid that is not a naturally occurring amino acid molecule as defined herein. The term "non-naturally occurring amino acid molecule" can be used synonymously with the term "amino acid analog." In some embodiments, the non-naturally occurring amino acid molecule is an amino acid formed by synthetic modification or manipulation of a naturally occurring amino acid. In some embodiments, a non-naturally occurring amino acid molecule can be a molecule which departs from the structure of the naturally occurring amino acids, but which have substantially the structure of an amino acid, such that they can be substituted within a polypeptide which retains its activity, e.g., ligand-binding activity. Thus, for example, in some embodiments amino acids can also include amino acids having side chain modifications or substitutions, and also include related organic acids, amides or the like. Examples of non-naturally occurring amino acid molecule include, but are not limited to, homocysteine; phosphoserine; phosphothreonine; phosphotyrosine; γ-carboxyglutamate; hippuric acid; octahydroindole-2-carboxylic acid; statine; 1,2,3,4,-tetrahydroisoquinoline-3-carboxylic acid; penicillamine (3-mercapto-D-valine); omithine (Om); citruline; alpha-methyl-alanine; para-benzoylphenylalanine; para-amino-phenylalanine; p-fluorophenylalanine; phenylglycine; prop-argylglycine; N-methylglycins (sarcosine, Sar); and tert-butylglycine; diaminobutyric acid; 7-hydroxy-tetrahydroisoquinoline carboxylic acid; naphthylalanine; biphenylalanine; cyclohexylalanine; amino-isobutyric acid (Aib); norvaline; norleucine (Nle); tert-leucine; tetrahydroisoquinoline carboxylic acid; pipecolic acid; phenylglycine; homophenylalanine; cyclohexylglycine; dehydroleucine; 2,2-diethylglycine; 1-amino-1-cyclopentanecarboxylic acid; 1-amino-1-cyclohexanecarboxylic acid; amino-benzoic acid; amino-naphthoic acid; gamma-aminobutyric acid; difluorophenylalanine; nipecotic acid; N-α-imidazole acetic acid (IMA); thienyl-alanine; t-butylglycine; desamino-Tyr; aminovaleric acid (Ava); pyroglutaminic acid (<Glu); α-aminoisobutyric acid (αAib); γ-aminobutyric acid (γAbu); α-aminobutyric acid (αAbu); αγ-aminobutyric acid (αγAbu); 3-pyridylalanine (Pal); Isopropyl-α-$N^\epsilon$lysine (ILys); Napthyalanine (Nal); α-napthyalanine (β-Nal); β-napthyalanine (β-Nal); Acetyl-β-napthyalanine (Ac-β-napthyalanine); α, β-napthyalanine; $N^\epsilon$-picoloyl-lysine (PicLys); 4-halo-Phenyl; 4-pyrolidylalanine; isonipecotic carboxylic acid (inip); beta-amino acids; and isomers, analogs and derivatives thereof.

In some embodiments, a non-naturally occurring amino acid molecule can be a chemically modified amino acid. As used herein, the term "chemically modified amino acid" refers to an amino acid that has been treated with one or more reagents.

In some embodiments, a non-naturally occurring amino acid molecule can be a beta-amino acid. Exemplary beta-amino acids include, but are not limited to, L-β-Homoproline hydrochloride; (±)-3-(Boc-amino)-4-(4-biphenylyl)butyric acid; (t)-3-(Fmoc-amino)-2-phenylpropionic acid; (1S, 3R)-(+)-3-(Boc-amino)cyclopentanecarboxylic acid; (2R, 3R)-3-(Boc-amino)-2-hydroxy-4-phenylbutyric acid; (2S, 3R)-3-(Boc-amino)-2-hydroxy-4-phenylbutyric acid; (R)-2-[(Boc-amino)methyl]-3-phenylpropionic acid; (R)-3-(Boc-amino)-2-methylpropionic acid; (R)-3-(Boc-amino)-2-phenylpropionic acid; (R)-3-(Boc-amino)-4-(2-naphthyl)butyric acid; (R)-3-(Boc-amino)-5-phenylpentanoic acid; (R)-3-(Fmoc-amino)-4-(2-naphthyl)butyric acid; (R)-(−)-Pyrrolidine-3-carboxylic acid; (R)-Boc-3,4-dimethoxy-β-Phe-OH; (R)-Boc-3-(3-pyridyl)-β-Ala-OH; (R)-Boc-3-(trifluoromethyl)-β-Phe-OH; (R)-Boc-3-cyano-β-Phe-OH; (R)-Boc-3-methoxy-3-Phe-OH; (R)-Boc-3-methyl-β-Phe-OH; (R)-Boc-4-(4-pyridyl)-β-Homoala-OH; (R)-Boc-4-(trifluoromethyl)-β-Homophe-OH; (R)-Boc-4-(trifluoromethyl)-β-Phe-OH; (R)-Boc-4-bromo-β-Phe-OH; (R)-Boc-4-chloro-β-Homophe-OH; (R)-Boc-4-chloro-β-Phe-OH; (R)-Boc-4-cyano-β-Homophe-OH; (R)-Boc-4-cyano-β-Phe-OH; (R)-Boc-4-fluoro-β-Phe-OH; (R)-Boc-4-methoxy-β-Phe-OH; (R)-Boc-4-methyl-β-Phe-OH; (R)-Boc-β-Tyr-OH; (R)-Fmoc-4-(3-pyridyl)-β-Homoala-OH; (R)-Fmoc-4-fluoro-β-Homophe-OH; (S)-(+)-Pyrrolidine-3-carboxylic acid; (S)-3-(Boc-amino)-2-methylpropionic acid; (S)-3-(Boc-amino)-4-(2-naphthyl)butyric acid; (S)-3-(Boc-amino)-5-phenylpentanoic acid; (S)-3-(Fmoc-amino)-2-methylpropionic acid; (S)-3-(Fmoc-amino)-4-(2-naphthyl)butyric acid; (S)-3-(Fmoc-amino)-5-hexenoic acid; (S)-3-(Fmoc-amino)-5-phenyl-pentanoic acid; (S)-3-(Fmoc-amino)-6-phenyl-5-hexenoic acid; (S)-Boc-2-(trifluoromethyl)-β-Homophe-OH; (S)-Boc-2-(trifluoromethyl)-β-Homophe-OH; (S)-Boc-2-(trifluoromethyl)-β-Phe-OH; (S)-Boc-2-cyano-β-Homophe-OH; (S)-Boc-2-methyl-β-Phe-OH; (S)-Boc-3,4-dimethoxy-β-Phe-OH; (S)-Boc-3-(trifluoromethyl)-β-Homophe-OH; (S)-Boc-3-(trifluoromethyl)-β-Phe-OH; (S)-Boc-3-methoxy-β-Phe-OH; (S)-Boc-3-methyl-β-Phe-OH; (S)-Boc-4-(4-pyridyl)-β-Homoala-OH; (S)-Boc-4-(trifluoromethyl)-β-Phe-OH; (S)-Boc-4-bromo-β-Phe-OH; (S)-Boc-4- chloro-β-Homophe-OH; (S)-Boc-4-chloro-β-Phe-OH; (S)-Boc-4-cyano-β-Homophe-OH; (S)-Boc-4-cyano-β-Phe-OH; (S)-Boc-4-fluoro-β-Phe-OH; (S)-Boc-4-iodo-β-Homophe-OH; (S)-Boc-4-methyl-β-Homophe-OH; (S)-Boc-4-methyl-β-Phe-OH; (S)-Boc-β-Tyr-OH; (S)-Boc-γ,γ-diphenyl-β-Homoala-OH; (S)-Fmoc-2-methyl-β-Homophe-OH; (S)-Fmoc-3,4-difluoro-β-Homophe-OH; (S)-Fmoc-3-(trifluoromethyl)-β-Homophe-OH; (S)-Fmoc-3-cyano-β-Homophe-OH; (S)-Fmoc-3-methyl-β-Homophe-OH; (S)-Fmoc-γ,γ-diphenyl-β-Homoala-OH; 2-(Boc-aminomethyl) phenylacetic acid; 3-Amino-3-β-bromophenyl)propionic acid; 3-Amino-4,4,4-trifluorobutyric acid; 3-Aminobutanoic acid; DL-β-Aminoisobutyric acid; DL-β-Aminoisobutyric acid puriss; DL-β-Homoleucine; DL-β-Homomethionine; DL-β-Homophenylalanine; DL-β-Leucine; DL-β-Phenylalanine; L-β-Homoalanine hydrochloride; L-β-Homoglutamic acid hydrochloride; L-β-Homoglutamine hydrochloride; L-β-Homohydroxyproline hydrochloride; L-β-Homoisoleucine hydrochloride; L-β-Homoleucine hydrochloride; L-β-Homolysine dihydrochloride; L-β-Homomethionine hydrochloride; L-β-Homophenylalanine allyl ester hydrochloride; L-β-Homophenylalanine hydrochloride; L-β-Homoserine; L-β-Homothreonine; L-β-Homotryptophan hydrochloride; L-β-Homotyrosine hydrochloride; L-β-Leucine hydrochloride; Boc-D-β-Leu-OH; Boc-D-β-Phe-OH; Boc-β³-Homopro-OH; Boc-β-Glu(OBzl)-OH; Boc-β-Homoarg(Tos)-OH; Boc-β-Homoglu(OBzl)-OH; Boc-β-Homohyp(Bzl)-OH (dicyclohexylammonium) salt technical; Boc-β-Homolys(Z)-OH; Boc-β-Homoser(Bzl)-OH; Boc-β-Homothr(Bzl)-OH; Boc-β-Homotyr(Bzl)-OH; Boc-β-Ala-OH; Boc-β-Gln-OH; Boc-β-Homoala-OAll; Boc-β-Homoala-OH; Boc-β-Homogln-OH; Boc-β-Homoile-OH; Boc-β-Homoleu-OH; Boc-β-Homomet-OH; Boc-β-Homophe-OH; Boc-β-Homotrp-OH; Boc-β-Homotrp-OMe; Boc-β-Leu-OH; Boc-β-Lys(Z)-OH (dicyclohexylammonium) salt; Boc-β-Phe-OH; Ethyl 3-(benzylamino)propionate; Fmoc-D-β-Homophe-OH; Fmoc-L-β³-homoproline; Fmoc-β-D-Phe-OH; Fmoc-β-Gln(Trt)-OH; Fmoc-β-Glu(OtBu)-OH; Fmoc-β-Homoarg(Pmc)-OH; Fmoc-β-Homogln(Trt)-OH; Fmoc-β-Homoglu(OtBu)-OH; Fmoc-β-Homohyp(tBu)-OH; Fmoc-β-Homolys(Boc)-OH; Fmoc-β-Homoser(tBu)-OH; Fmoc-β-Homothr(tBu)-OH; Fmoc-β-Homotyr(tBu)-OH; Fmoc-4-Ala-OH; Fmoc-β-Gln-OH; Fmoc-β-Homoala-OH; Fmoc-β-Homogln-OH; Fmoc-β-Homoile-OH; Fmoc-β-Homoleu-OH; Fmoc-β-Homomet-OH; Fmoc-β-Homophe-OH; Fmoc-β-Homotrp-OH; Fmoc-β-Leu-OH; Fmoc-β-Phe-OH; N-Acetyl-DL-β-phenylalanine; Z-D-β-Dab(Boc)-OH; Z-D-β-Dab(Fmoc)-OH purum; Z-DL-β-Homoalanine; Z-β-D-Homoala-OH; Z-β-Glu(OtBu)-OH technical; Z-β-Homotrp(Boc)-OH; Z-β-Ala-OH purum; Z-β-Ala-ONp purum; Z-β-Dab(Boc)-OH; Z-β-Dab(Fmoc)-OH; Z-β-Homoala-OH; 3-Alanine; β-Alanine BioXtra; β-Alanine ethyl ester hydrochloride; β-Alanine methyl ester hydrochloride; β-Glutamic acid hydrochloride; cis-2-Amino-3-cyclopentene-1-carboxylic acid hydrochloride; cis-3-(Boc-amino)cyclohexanecarboxylic acid; and cis-3-(Fmoc-amino)cyclohexanecarboxylic acid.

In some embodiments, the $X_1$ can be a Gly molecule or an analog thereof.

In some embodiments, the $X_2$ can be an Arg molecule or an analog thereof.

In some embodiments, the $X_3$ can be a Gly molecule or an analog thereof.

In some embodiments, a competing peptide for binding to a modified $\alpha_v\beta_6$ polypeptide dimer described herein can comprise an amino acid sequence of Gly-Arg-Gly-Asp-Leu-Gly-Arg-Leu (SEQ ID NO: 68). In some embodiments, a competing peptide for binding to a modified $\alpha_v\beta_6$ polypeptide dimer described herein can comprise an amino acid sequence of Gly-Arg-Gly-Asp-Leu-Gly-Arg-Ile (SEQ ID NO: 69).

In some embodiments, the competing agent can further comprise a detectable label. As used herein in reference to a test agent or a competing agent, the term "detectable label" refers to a composition capable of producing a detectable signal indicative of the presence of a target with the detectable label attached thereto. Detectable labels include any composition detectable by spectroscopic, photochemical, biochemical, immunochemical, electrical, optical or chemical means. Suitable labels include fluorescent molecules, radioisotopes, nucleotide chromophores, enzymes, substrates, chemiluminescent moieties, bioluminescent moieties, and the like. As such, a label is any composition detectable by spectroscopic, photochemical, biochemical, immunochemical, electrical, optical or chemical means needed for the methods and devices described herein.

A wide variety of fluorescent reporter dyes are known in the art. Typically, the fluorophore is an aromatic or heteroaromatic compound and can be a pyrene, anthracene, naphthalene, acridine, stilbene, indole, benzindole, oxazole, thiazole, benzothiazole, cyanine, carbocyanine, salicylate, anthranilate, coumarin, fluorescein, rhodamine or other like compound.

Exemplary fluorophores include, but are not limited to, 1,5 IAEDANS; 1,8-ANS; 4-Methylumbelliferone; 5-carboxy-2,7-dichlorofluorescein; 5-Carboxyfluorescein (5-FAM); 5-Carboxynapthofluorescein (pH 10); 5-Carboxytetramethylrhodamine (5-TAMRA); 5-FAM (5-Carboxyfluorescein); 5-Hydroxy Tryptamine (HAT); 5-ROX (carboxy-X-rhodamine); 5-TAMRA (5-Carboxytetramethylrhodamine); 6-Carboxyrhodamine 6G; 6-CR 6G; 6-JOE; 7-Amino-4-methylcoumarin; 7-Aminoactinomycin D (7-AAD); 7-Hydroxy-4-methylcoumarin; 9-Amino-6-chloro-2-methoxyacridine; ABQ; Acid Fuchsin; ACMA (9-Amino-6-chloro-2-methoxyacridine); Acridine Orange; Acridine Red; Acridine Yellow; Acriflavin; Acriflavin Feulgen SITSA; Aequorin (Photoprotein); Alexa Fluor 350™; Alexa Fluor 430™; Alexa Fluor 488™; Alexa Fluor 532™; Alexa Fluor 546™; Alexa Fluor 568™; Alexa Fluor 594™; Alexa Fluor 633™; Alexa Fluor 647™; Alexa Fluor 660™; Alexa Fluor 680™; Alizarin Complexon; Alizarin Red; Allophycocyanin (APC); AMC, AMCA-S; AMCA (Aminomethylcoumarin); AMCA-X; Aminoactinomycin D; Aminocoumarin; Anilin Blue; Anthrocyl stearate; APC-Cy7; APTS; Astrazon Brilliant Red 4G; Astrazon Orange R; Astrazon Red 6B; Astrazon Yellow 7 GLL; Atabrine; ATTO-TAG™ CBQCA; ATTO-TAG™ FQ; Auramine; Aurophosphine G; Aurophosphine; BAO 9 (Bisaminophenyloxadiazole); BCECF (high pH); BCECF (low pH); Berberine Sulphate; Beta Lactamase; BFP blue shifted GFP (Y66H); BG-647; Bimane; Bisbenzamide; Blancophor FFG; Blancophor SV; BOBO™-1; BOBO™-3; Bodipy 492/515; Bodipy 493/503; Bodipy 500/510; Bodipy 505/515; Bodipy 530/550; Bodipy 542/563; Bodipy 558/568; Bodipy 564/570; Bodipy 576/589; Bodipy 581/591; Bodipy 630/650-X; Bodipy 650/665-X; Bodipy 665/676; Bodipy Fl; Bodipy FL ATP; Bodipy Fl-Ceramide; Bodipy R6G SE; Bodipy TMR; Bodipy TMR-X conjugate; Bodipy TMR-X, SE; Bodipy TR; Bodipy TR ATP; Bodipy TR-X SE; BO-PRO™-1; BO-PRO™-3; Brilliant Sulphoflavin FF; Calcein; Calcein Blue; Calcium Crimson™; Calcium Green; Calcium Green-1 Ca2+ Dye; Calcium Green-2 Ca2+; Calcium Green-5N Ca2+; Calcium Green-C18 Ca2+; Calcium Orange; Calcofluor White; Carboxy-X-rhodamine (5-ROX); Cascade Blue®; Cascade Yellow; Catecholamine; CFDA; CFP—Cyan Fluorescent Protein; Chlorophyll; Chromomycin A; Chromomycin A; CMFDA; Coelenterazine; Coelenterazine cp; Coelenterazine f; Coelenterazine fcp; Coelenterazine h; Coelenterazine hcp; Coelenterazine ip; Coelenterazine O; Coumarin Phalloidin; CPM Methylcoumarin; CTC; Cy2™; Cy3.1 8; Cy3.5™; Cy3M; Cy5.1 8; Cy5.5™; Cy5™; Cy7™; Cyan GFP; cyclic AMP Fluorosensor (FiCRhR); d2; Dabcyl; Dansyl; Dansyl Amine; Dansyl Cadaverine; Dansyl Chloride; Dansyl DHPE; Dansyl fluoride; DAPI; Dapoxyl; Dapoxyl 2; Dapoxyl 3; DCFDA; DCFH (Dichlorodihydrofluorescein Diacetate); DDAO; DHR (Dihydrorhodamine 123); Di-4-ANEPPS; Di-8-ANEPPS (non-ratio); DiA (4-Di-16-ASP); DIDS; Dihydorhodamine 123 (DHR); DiO (DiOC18(3)); DiR; DiR (DiIC18(7)); Dopamine; DsRed; DTAF; DY-630-NHS; DY-635-NHS; EBFP; ECFP; EGFP; ELF 97; Eosin; Erythrosin; Erythrosin ITC; Ethidium homodimer-1 (EthD-1); Euchrysin; Europium (III) chloride; Europium; EYFP; Fast Blue; FDA; Feulgen (Pararosaniline); FITC; FL-645; Flazo Orange; Fluo-3; Fluo-4; Fluorescein Diacetate; Fluoro-Emerald; Fluoro-Gold (Hydroxystilbamidine); Fluor-Ruby; FluorX; FM 1-43™; FM 4-46; Fura Red™ (high pH); Fura-2, high calcium; Fura-2, low calcium; Genacryl Brilliant Red B; Genacryl Brilliant Yellow 10GF; Genacryl Pink 3G; Genacryl Yellow 5GF; GFP (S65T); GFP red shifted (rsGFP); GFP wild type, non-UV excitation (wtGFP); GFP wild type, UV excitation (wtGFP); GFPuv; Gloxalic Acid; Granular Blue; Haematoporphyrin; Hoechst 33258; Hoechst 33342; Hoechst 34580; HPTS; Hydroxycoumarin; Hydroxystilbamidine (FluoroGold); Hydroxytryptamine; Indodicarbocyanine (DiD); Indotricarbocyanine (DiR); Intrawhite Cf; JC-1; JO-JO-1; JO-PRO-1; LaserPro; Laurodan; LDS 751; Leucophor PAF; Leucophor SF; Leucophor WS; Lissamine Rhodamine; Lissamine Rhodamine B; LOLO-1; LO-PRO-1; Lucifer Yellow; Mag Green; Magdala Red (Phloxin B); Magnesium Green; Magnesium Orange; Malachite Green; Marina Blue; Maxilon Brilliant Flavin 10 GFF; Maxilon Brilliant Flavin 8 GFF; Merocyanin; Methoxycoumarin; Mitotracker Green FM; Mitotracker Orange; Mitotracker Red; Mitramycin; Monobromobimane; Monobromobimane (mBBr-GSH); Monochlorobimane; MPS (Methyl Green Pyronine Stilbene); NBD; NBD Amine; Nile Red; Nitrobenzoxadidole; Noradrenaline; Nuclear Fast Red; Nuclear Yellow; Nylosan Brilliant Iavin E8G; Oregon Green™; Oregon Green 488-X; Oregon Green™ 488; Oregon Green™ 500; Oregon Green™ 514; Pacific Blue; Pararosaniline (Feulgen); PE-Cy5; PE-Cy7; PerCP; PerCP-Cy5.5; PE-TexasRed (Red 613); Phloxin B (Magdala Red); Phorwite AR; Phorwite BKL; Phorwite Rev; Phorwite RPA; Phosphine 3R; PhotoResist; Phycoerythrin B [PE]; Phycoerythrin R [PE]; PKH26; PKH67; PMIA; Pontochrome Blue Black; POPO-1; POPO-3; PO-PRO-1; PO-PRO-3; Primuline; Procion Yellow; Propidium Iodid (PI); PyMPO; Pyrene; Pyronine; Pyronine B; Pyrozal Brilliant Flavin 7GF; QSY 7; Quinacrine Mustard; Resorufin; RH 414; Rhod-2; Rhodamine; Rhodamine 110; Rhodamine 123; Rhodamine 5 GLD; Rhodamine 6G; Rhodamine B 540; Rhodamine B 200; Rhodamine B extra; Rhodamine BB; Rhodamine BG; Rhodamine Green; Rhodamine Phallicidine; Rhodamine Phalloidine; Rhodamine Red; Rhodamine WT; Rose Bengal; R-phycoerythrin (PE); red shifted GFP (rsGFP, S65T); S65A; S65C; S65L; S65T; Sapphire GFP; Serotonin; Sevron Brilliant Red 2B; Sevron Brilliant Red 4G; Sevron Brilliant Red B; Sevron Orange; Sevron Yellow L; sgBFP™; sgBFP™ (super glow BFP); sgGFP™; sgGFP™ (super glow GFP); SITS; SITS (Primuline); SITS (Stilbene Isothiosulphonic Acid); SPQ (6-methoxy-N-β-sulfopropyl)-quinolinium); Stilbene; Sulphorhodamine B can C; Sulphorhodamine G Extra; Tetracycline; Tetramethylrhodamine; Texas Red™; Texas Red-X™ conjugate; Thiadicarbocyanine (DiSC3); Thiazine Red R; Thiazole Orange; Thioflavin 5; Thioflavin S; Thioflavin TCN; Thiolyte; Thiozole Orange; Tinopol CBS (Calcofluor White); TMR; TO-PRO-1; TO-PRO-3; TO-PRO-5; TOTO-1; TOTO-3; TriColor (PE-Cy5); TRITC (TetramethylRodaminelsoThioCyanate); True Blue; Tru-Red; Ultralite; Uranine B; Uvitex SFC; wt GFP; WW 781; XL665; X-Rhodamine; XRITC; Xylene Orange; Y66F; Y66H; Y66W; Yellow GFP; YFP; YO-PRO-1; YO-PRO-3; YOYO-1; and YOYO-3. Many suitable forms of these fluorescent compounds are available and can be used.

Other exemplary detectable labels include luminescent and bioluminescent markers (e.g., biotin, luciferase (e.g., bacterial, firefly, click beetle and the like), luciferin, and aequorin), radiolabels (e.g., $^3H$, $^{125}I$, $^{35}S$, $^{14}C$, or $^{32}P$), enzymes (e.g., galactosidases, glucorinidases, phosphatases (e.g., alkaline phosphatase), peroxidases (e.g., horseradish peroxidase), and cholinesterases), and calorimetric labels such as colloidal gold or colored glass or plastic (e.g., polystyrene, polypropylene, and latex) beads. Patents teaching the use of such labels include U.S. Pat. Nos. 3,817,837, 3,850,752, 3,939,350, 3,996,345, 4,277,437, 4,275,149, and 4,366,241, each of which is incorporated herein by reference.

Means of detecting such labels are well known to those of skill in the art. Thus, for example, radiolabels can be detected using photographic film or scintillation counters, fluorescent markers can be detected using a photo-detector to detect emitted light. Enzymatic labels are typically detected by providing the enzyme with an enzyme substrate and detecting the reaction product produced by the action of the enzyme on the enzyme substrate, and calorimetric labels can be detected by visualizing the colored label.

In some embodiments, the detectable label is a fluorophore or a quantum dot. Without wishing to be bound by a theory, using a fluorescent reagent can reduce signal-to-noise in the imaging/readout, thus maintaining sensitivity.

In some embodiments, a detectable label can include, but is not limited to, biotin, a fluorescent dye or molecule, a luminescent or bioluminescent marker, a radiolabel, an enzyme, a quantum dot, an imaging agent, or any combination thereof. Methods for detecting various types of the detectable labels are known in the art and are described above.

In some embodiments where the detectable label comprises a fluorescent molecule, signals from the fluorescent labels can be detected, e.g., by fluorescence anisotropy and/or flow cytometry. Fluorescence anisotropy can be used to measure the binding constants and kinetics of reactions that cause a change in the rotational time of the molecules. If the fluorophore (detectable label) remains bound to a ligand (e.g., a test agent or a competing agent described below) without binding to integrin, the rate at which it tumbles can decrease significantly when it is bound tightly to a large protein such as an integrin. If the fluorophore (detectable label) conjugated to a test agent and/or competing agent which binds to the larger integrin protein in a binding pair, the difference in polarization between bound and unbound states will be smaller (because the unbound protein will already be fairly stable and tumble slowly to begin with) and the measurement will be less accurate. The degree of binding is calculated by using the difference in anisotropy of the partially bound, free and fully bound (large excess of protein) states measured by titrating the two binding partners. Methods for using fluorescence anisotropy to identify agents with affinity for a target molecule are known in the art, including, e.g., the methods as described in the International Application No. WO 19998/039484, the content of which is incorporated herein by reference.

Where the competing agent comprises a detectable label, signal from the competing agent is detected instead of the test agent. Thus, if the signal from the competing agent is reduced upon contacting the modified integrin polypeptide dimer with the test agent, where the concentrations of the test agent and the competing agent are the same, this indicates that the test agent has a higher binding affinity than the competing agent to the modified integrin polypeptide dimer described herein.

Accordingly, yet another aspect provided herein relates to a method for determining binding affinity of a test agent to an integrin heterodimer. The method comprises (i) contacting one or more modified integrin polypeptide dimers described herein with a test agent and a competing agent, wherein the competing agent comprises a detectable label and is capable of competing with the test agent to bind the modified integrin polypeptide dimer; and (ii) detecting a signal from the detectable label of the competing agent that forms a complex with the integrin. A decrease in the detected signal (e.g., by at least about 10% or more, including, at least about 20%, at least about 30%, at least about 40%, at least about 50%, at least about 60%, at least about 70%, at least about 80%, at least about 90%, at least about 95% or higher) relative to a signal corresponding to saturation binding of the competing agent to the modified integrin polypeptide dimer indicates that the test agent has a higher binding affinity than the competing agent to the integrin.

The term "saturation binding" generally refers to all binding sites of a target molecule being occupied by interaction with one specific ligand. Therefore, as used herein, the term "saturation binding" refers to all binding sites of the modified integrin polypeptide dimers described herein being occupied by a competing agent in the absence of any test agent. However, upon addition of a test agent that has a higher binding affinity than the competing agent to the modified integrin polypeptide dimers described herein, fewer molecules of competing agent can bind to the modified polypeptide dimers, resulting in a reduced signal from the competing agent.

As used herein, the term "binding affinity" generally refers to an overall binding property of a first agent (e.g., a ligand or a test agent) interacting with a second agent (e.g., a target protein such as integrin $\alpha_v\beta_6$ heterodimer) under a specific condition, and the overall binding property is typically dependent on intrinsic characteristics of the first agent and the second agent including, but not limited to, the conformation of the first agent and/or the second agent, single-bond affinity, avidity, as well as the surrounding/ambient condition for the binding interaction, e.g., but not limited to, concentration of the first agent and/or the second agent, and/or the presence of other interfering molecules during the binding interaction between the first and the second agents. Different measures of a binding affinity of an agent are known in the art. In some embodiments, the binding affinity of a first agent for a second agent can be indicated by dissociation constant ($K_d$) for binding of the first agent to the second agent. The dissociation constant ($K_d$) is an equilibrium constant that generally measures the propensity of a bound complex to separate (dissociate) reversibly into separate agents. In these embodiments, a higher dissociation constant indicates a lower effective binding affinity. Alternatively, the effective binding affinity of a first agent for a second agent can be indicated by an association constant (K) for binding of the first agent to the second agent. The association constant (K) is the inverse of the dissociation constant ($K_d$), i.e., a higher association constant indicates a higher effective binding affinity.

As used herein, the term "single-bond affinity" refers to the strength of a single bond interaction, including but not limited to hydrogen bonds, electrostatic bonds, van der Waals forces, hydrophobic forces, or any combinations thereof.

As used herein, the term "avidity" refers to the combined strength of multiple bond interactions. Avidity is distinct from affinity or single-bond affinity, which is the strength of a single bond interaction. In general, avidity is the combined synergistic strength of bond affinities rather than the sum of bonds. Accordingly, avidity is generally used to describe one agent having multiple interactions with another agent. For example, a ligand or a test agent can have multiple interactions with a modified integrin polypeptide dimer (e.g., a modified integrin $\alpha_v\beta_6$ polypeptide dimer described herein).

Drug Discovery and Development Process

As noted above, the modified integrin polypeptide dimers described herein can form crystal structures. Thus, the binding domain of the dimer can be readily identified using any methods known in the art, e.g., X-ray crystallography. Indeed, the inventors have identified a novel hydrophobic binding pocket of an integrin $\alpha_v\beta_6$ heterodimer based on the crystal structure of the modified integrin $\alpha_v\beta_6$ polypeptide dimer described herein. Accordingly, the inventors employ the information of the novel hydrophobic binding pocket to design a pharmacophore model for an agent that can bind to the hydrophobic binding pocket of the integrin $\alpha_v\beta_6$ heterodimer.

In some embodiments, the pharmacophore model can be designed for an anti-$\alpha_v\beta_6$ inhibitor. Therefore, provided herein is also a method of identifying an anti-$\alpha_v\beta_6$ inhibitor. The method comprises: (a) generating on a computer a molecular representation of a pharmacophore comprising a basic functional group, an acidic functional group for coordination of a metal ion to a metal ion-dependent adhesion site (MIDAS) in integrin $\beta_6$ polypeptide, a first hydrophobic functional group, and a second hydrophobic functional group, wherein the functional groups are arranged to satisfy the following conditions:

the distance between the first hydrophobic functional group (H1) and the second hydrophobic functional group (H2) is about 7-8 Å; the distance between the second hydrophobic functional group (H2) and the basic functional group (B) is about 8-9 Å; the distance between the basic functional group (B) and the acidic functional group (A) is about 15-16 Å; the distance between the first hydrophobic functional group (H1) and the acidic functional group (A) is about 14.5-15.5 Å; and the distance between the second hydrophobic functional group (H2) and the acidic functional group (A) is about 19-20 Å; and the angle formed by H1-A-B is about 20°-24°; the angle formed by H1-A-H2 is about 17°-21°; the angle formed by H2-A-B is about 26°-30°; the angle formed by A-B-H1 is about 68°-72°; the angle formed by A-B-H2 is about 96°-100°; and the angle formed by H1-B-H2 is about 490-530; (b) generating on a computer atomic coordinates of an $\alpha_v\beta_6$ integrin protein or a portion thereof having at least a hydrophobic binding pocket in $\beta_6$ subunit; and (c) determining on a computer likelihood of the molecular representation interacting with one or more residues of the computer-generated $\alpha_v\beta_6$ integrin protein or a portion thereof, thereby identifying a candidate anti-$\alpha_v\beta_6$ inhibitor.

In some embodiments, the first and second hydrophobic functional groups can each independently have an aromatic ring (aryl) or linear moiety.

In some embodiments, the functional groups of the pharmacophore can be arranged to satisfy the following conditions:

the distance between the first hydrophobic functional group and the second hydrophobic functional group is about 7.403 Å; the distance between the second hydrophobic functional group and the basic functional group is about 8.462 Å; the distance between the basic functional group and the acidic functional group is about 15.639 Å; the distance between the first hydrophobic functional group and the acidic functional group is about 15.005 Å; and the distance between the second hydrophobic functional group and the acidic functional group is about 19.553 Å; and the angle formed by H1-A-B is about 22.4°; the angle formed by H1-A-H2 is about 19.4°; the angle formed by H2-A-B is about 28.7°; the angle formed by A-B-H1 is about 70.7°; the angle formed by A-B-H2 is about 98.10; and the angle formed by H1-B-H2 is about 51.1°.

In some embodiments, the determining step (c) can further comprise fitting the molecular representation to determine the probability of the molecular representation interacting with one or more residues of the computer generated $\alpha_v\beta_6$ integrin protein or a portion thereof. By "fitting" is meant determining by automatic, or semi-automatic means, interactions between one or more atoms of a candidate molecule and at least one atom of a $\alpha_v\beta_6$ integrin protein or a portion thereof structure and calculating the extent to which such interactions are stable. Interactions include attraction and repulsion, brought about by charge, and/or steric considerations and the like. Interactions of this type can be modeled computationally. An example of such computation would be via a force field such as Amber (Cornell et al. A Second Generation Force Field for the Simulation of Proteins, Nucleic Acids, and Organic Molecules, Journal of the American Chemical Society, (1995), 117(19), 5179-97) which would assign partial charges to atoms on the protein and ligand and evaluate the electrostatic interaction energy between a protein and ligand atom using the Coulomb potential. The Amber force field would also assign van der Waals energy terms to assess the attractive and repulsive steric interactions between two atoms. Other methods of assessing interactions are available and would be known to one skilled in the art of designing molecules consistent with specified pharmacophores.

As used herein, the term "pharmacophore" refers to a best description for a three-dimensional orientation of a set of features which describe the physical, chemical, steric, and/or electronic environment of the active sites of a molecule, compound, or a structure, said features comprising. Examples of pharmacophoric features include, but are not limited to, the hydrogen bond donor feature, the hydrogen bond acceptor feature, the hydrophobic or lipophilic region feature, the ionizable region feature (e.g., acidic or basic functional groups), and the ring aromatic feature. A pharmacophore model generally explains how structurally diverse molecules can bind to a common target site. Furthermore, pharmacophore models can be used to identify through denovo design or virtual screening novel ligands that will bind to the same target site.

As used herein, the term "active site" refers to a site (such as an atom, a functional group of an amino acid residue or a plurality of such atoms and/or groups) that is capable of binding to an integrin $\alpha\beta$ heterodimer and block the corresponding integrin signaling.

The term "hydrogen bond" as used herein refers to an interaction that occurs whenever a suitable donor atom bearing a proton, H, and a suitable acceptor atom. Sometimes, a single acceptor atom can form a plurality of hydrogen bonds with a plurality of protons on suitable donor atoms. Sometimes, a single proton on a donor atom can form hydrogen bonds with a plurality of suitable acceptor atoms. For example, the proton on a —NH-group may form a separate hydrogen bond with each of the two oxygen atoms in a carboxylate anion. Suitable donor and acceptor atoms are well understood in medicinal chemistry (G. C. Pimentel and A. L. McClellan, The Hydrogen Bond, Freeman, San Francisco, 1960; R. Taylor and O. Kennard, Hydrogen Bond Geometry in Organic Crystals, Accounts of Chemical Research, 17, pp. 320-326 (1984)).

As used herein, the term "hydrogen bond donor" refers to a chemical structure containing a suitable hydrogen bond donor atom bearing one or more protons. It refers to a group having a hydrogen atom capable of forming a hydrogen bond with acceptor atom in the same or an adjacent molecule; see for example "Advanced Organic Chemistry" by Jerry March, 4th edition, which is incorporated herein by reference. Examples of donor atoms having one proton are —NH, C—NH2, C—NH, C—OH, C—SH, or aromatic C—H. Examples of donor atoms having more than one proton are —NH2, —[NH3]+ and [NH4]+.

As used herein, the term "hydrogen bond acceptor" refers to a chemical structure containing a suitable hydrogen bond acceptor atom. It generally refers to a group capable of forming a hydrogen bond with a hydrogen atom in the same or an adjacent molecule; see for example "Advanced Organic Chemistry" by Jerry March, 4th edition, which is incorporated herein by reference. Examples of acceptor atoms include fluorine, oxygen, sulfur and nitrogen and thus in the present context, hydrogen bond acceptors include nitrogen, oxygen and sulphur atoms; and groups containing nitrogen, oxygen and sulphur atoms.

The term "lipophilic" or "hydrophobic" refers to a non-polar moiety that tends not to dissolve in water and is fat-soluble. Hydrophobic moieties include, but are not limited to, hydrocarbons, such as alkanes, alkenes, alkynes, cycloalkanes, ethers, cycloalkenes, cycloalkynes and aromatic compounds, such as aryls, certain saturated and unsaturated heterocycles, and moieties that are substantially similar to the side chains of lipophilic natural and unnatural amino acids, including valine, leucine, isoleucine, methionine, phenylalanine, α-amino isobutyric acid, alloisoleucine, tyrosine, and tryptophan. Lipophilic interactions can be modeled using a variety of means. For example the ChemScore function (Eldridge M D; Murray C W; Auton T R; Paolini G V; Mee R P Empirical scoring functions: I. The development of a fast empirical scoring function to estimate the binding affinity of ligands in receptor complexes, Journal of computer-aided molecular design (1997 September), 11(5), 425-45) assigns protein and ligand atoms as hydrophobic or polar, and a favorable energy term is specified for the interaction between two hydrophobic atoms. Other methods of assessing the hydrophobic contributions to ligand binding are available and these would be known to one skilled in the art.

The term "polar" as used herein refers to compounds having one or more polar bonds in which the electron density of the bond lies closer to one atom than the other as one of the atoms is more electronegative than the other. This means that one of the atoms develops a degree of positive charge while the other some degree of negative charge. Compounds having polar bonds generally have dipole moments. In contrast, covalent bonds between atoms having the same electronegativity are symmetric.

As used herein, the term "acidic" refers to the tendency of compounds to donate a proton (H+) (Bronsted-Lowry Theory) or accept an electron pair into an empty orbital (Lewis Theory of Acids and Bases). An exemplary acidic functional group is a carboxylic acid group.

As used herein, the term "basic" refers to the tendency of compounds to accept a proton (H+) (Bronsted-Lowry Theory) or donate an electron pair (Lewis Theory of Acids and Bases). An exemplary basic functional group is an amino group.

In accordance with some aspects described herein, a phamacophore refers to a best description for a three-dimensional orientation of a set of features, which describe the physical, chemical, steric, and/or electronic environment of the active sites of an anti-$\alpha_v\beta_6$ integrin inhibitor. In some embodiments, the pharmacophore model for an anti-$\alpha_v\beta_6$ inhibitor can comprise a basic functional group, an acidic functional group for coordination of a metal ion to a metal ion-dependent adhesion site (MIDAS) in integrin $\beta_6$ polypeptide, a first hydrophobic functional group, and a second hydrophobic functional group.

Determination of an anti-$\alpha_v\beta_6$ inhibitor pharmacophore can greatly assist the process of rational drug design. This information can be used for rational design of anti-$\alpha_v\beta_6$ inhibitors, e.g. by computational techniques which identify possible binding ligands for the binding sites, by linked-fragment approaches to drug design, and by structure-based design based on the location of bound ligand. These techniques are discussed in more detail below.

Greer et al. (J. of Medicinal Chemistry, Vol. 37, (1994), 1035-1054) describe an iterative approach to ligand design based on repeated sequences of computer modelling, protein-ligand complex formation and X-ray crystallographic or NMR spectroscopic analysis. Thus novel thymidylate synthase inhibitor series were designed de novo by Greer et al., and anti-$\alpha_v\beta_6$ inhibitors may also be designed in a similar way. More specifically, using e.g. GRID on the solved 3D structure of the integrin $\alpha_v\beta_6$ heterodimer, a ligand (e.g. a candidate modulator in particular an inhibitor) for integrin $\alpha_v\beta_6$ heterodimer can be designed that complements the functionalities of integrin $\alpha_v\beta_6$ binding sites. The ligand can then be synthesised, formed into a complex with the integrin $\alpha_v\beta_6$, and the complex then analysed by X-ray crystallography to identify the actual position of the bound ligand. The structure and/or functional groups of the ligand can then be adjusted, if necessary, in view of the results of the X-ray analysis, and the synthesis and analysis sequence repeated until an optimised ligand is obtained. Related approaches to structure-based drug design are also discussed in Bohacek et al., Medicinal Research Reviews, Vol. 16, (1996), 3-50.

Structure-based drug design and in silico approaches to drug design require accurate information on the atomic coordinates of target proteins or receptors. The coordinates used in the design, selection and analysis of the candidate anti-$\alpha_v\beta_6$ inhibitors can be crystal structures for examples obtained from the Protein Data Bank or obtained in house, or homology models. In some embodiments, the coordinates used in the design, selection and analysis of the candidate anti-$\alpha_v\beta_6$ inhibitors can be crystal structure of $\alpha_v\beta_6$ headpiece identified by the inventors as described in the Examples. Homology models can be generated using "homology modelling." By "homology modelling", it is meant the prediction of structures for example of integrin $\alpha_v\beta_6$, based either on X-ray crystallographic data (for example of $\alpha_v\beta_6$ headpiece) or computer-assisted de novo prediction of structure, based upon manipulation of the coordinate data of existing integrin domain structures. Homology modelling as such is a technique that is well known to those skilled in the art (see e.g. Greer, Science, Vol. 228, (1985), 1055, and Blundell et al., Eur. J. Biochem, Vol. 172, (1988), 513). The techniques described in these references, as well as other homology modeling techniques, generally available in the art, may be used in performing the present invention.

Homology modelling comprises the steps of: (a) aligning a representation of an amino acid sequence of a target protein of unknown three-dimensional structure with the amino acid sequence of the known protein to match homologous regions of the amino acid sequences; (b) modeling the structure of the matched homologous regions of said target protein of unknown structure on the corresponding regions of the known structure; and (c) determining a conformation for said target protein of unknown structure which substantially preserves the structure of said matched homologous regions. In particular one or all of steps (a) to (c) are performed by computer modeling.

The term "homologous regions" describes amino acid residues in two sequences that are identical or have similar (e.g. aliphatic, aromatic, polar, negatively charged, or positively charged) side-chain chemical groups. Identical and similar residues in homologous regions are sometimes described as being respectively "invariant" and "conserved" by those skilled in the art.

In general, the method involves comparing the amino acid sequence of proteins of unknown structure with the proteins of known structure by aligning the amino acid sequences (Dunbrack et al., Folding and Design, 2, (1997), 27-42). Amino acids in the sequences are then compared and groups of amino acids that are homologous (conveniently referred to as "corresponding regions") are grouped together. This method detects conserved regions of the polypeptides and accounts for amino acid insertions or deletions. Homology between amino acid sequences can be determined using commercially available algorithms. The programs BLAST, gapped BLAST, BLASTN, PSI-BLAST and BLAST 2 sequences (provided by the National Center for Biotechnology Information) are widely used in the art for this purpose, and can align homologous regions of two amino acid sequences.

Once the amino acid sequences of the polypeptides with known and unknown structures are aligned, the structures of the conserved amino acids in a computer representation of the polypeptide with known structure are transferred to the corresponding amino acids of the polypeptide whose structure is unknown. For example, a tyrosine in the amino acid sequence of known structure may be replaced by a phenylalanine, the corresponding homologous amino acid in the amino acid sequence of unknown structure.

The structures of amino acids located in non-conserved regions can be assigned manually by using standard peptide geometries or by molecular simulation techniques, such as molecular dynamics. The final step in the process is accomplished by refining the entire structure using molecular dynamics and/or energy minimization.

Linked-fragment approaches to drug design can also be used to design anti-$\alpha_v\beta_6$ inhibitors comprising the pharmacophore. The fragment-linking approach involves determining (computationally or experimentally) the binding locations of plural ligands to a target molecule, and then constructing a molecular scaffold to connect the ligands together in such a way that their relative binding positions are preserved. The ligands may be provided computationally and modeled in a computer system, or provided in an experimental setting, wherein, for example, X-ray crystallography is used to determine their location. The pharmacophore of anti-$\alpha_v\beta_6$ inhibitor described herein can be considered to be one such fragment for use in a linked fragment approach.

The binding site of two or more ligands are determined and may be connected to form a potential lead compound that can be further refined using e.g. the iterative technique of Greer et al. For a virtual linked-fragment approach see Verlinde et al., J. of Computer-Aided Molecular Design, 6, (1992), 131-147, and for NMR and X-ray approaches see Shuker et al., Science, 274, (1996), 1531-1534 and Stout et al., Structure, 6, (1998), 839-848. The use of these approaches with the pharmacophore described herein can be used to design anti-$\alpha_v\beta_6$ inhibitors.

Many of the techniques and approaches to structure-based drug design described above rely at some stage on X-ray analysis to identify the binding position of a ligand in a ligand-protein complex. A common way of doing this is to perform X-ray crystallography on the complex, produce a difference Fourier electron density map, and associate a particular pattern of electron density with the ligand. However, in order to produce the map (as explained e.g. by Blundell, T L and Johnson, L N, in Protein Crystallography, Academic Press, New York, London and San Francisco, (1976)) it is necessary to know beforehand the protein 3D structure (or at least the protein structure factors).

The provision of the pharmacophore described herein will also allow the development of compounds or molecules which interact with the binding pocket regions of integrin $\alpha_v\beta_6$ heterodimer (for example to act as inhibitors of an $\alpha_v\beta_6$ integrin) based on a fragment linking or fragment growing approaches.

For example, pharmacophore model for an anti-$\alpha_v\beta_6$ inhibitor described herein can provide a starting point for medicinal chemistry to optimize the interactions using a structure-based approach. The fragments can be combined onto a template e.g., the pharmacophore model for an anti-$\alpha_v\beta_6$ inhibitor described herein could be used as the starting point for 'growing out' an inhibitor into other pockets of the protein (Blundell T L, Jhoti H, Abell C, Nature Reviews Drug Discovery, 1, 45-54, 2002, Carr, R; Jhoti, H; Drug Discov. Today, 2002, 7(9), 522-527). The fragments can be positioned in the binding pockets of integrin $\alpha_v\beta_6$ and then 'grown' to fill the space available, exploring the electrostatic, van der Waals or hydrogen-bonding interactions that are involved in molecular recognition. The potency of the original weakly binding fragment thus can be rapidly improved using iterative structure-based chemical synthesis.

At one or more stages in the fragment growing approach, the compound may be synthesized and tested in a biological system for its activity. This can be used to guide the further growing out of the fragment.

Where two fragment-binding regions are identified, a linked fragment approach may be based upon attempting to link the two fragments directly, or growing one or both fragments in the manner described above in order to obtain a larger, linked structure, which may have the desired properties.

In some embodiments, the pharmacophore model for an anti-$\alpha_v\beta_6$ inhibitor described herein can be used in in silico analysis and design. Current computational techniques provide a powerful alternative to the need to generate crystals and generate and analyse diffraction data. Accordingly, one aspect described herein relates to in silico methods directed to the analysis and development of anti-$\alpha_v\beta_6$ inhibitors comprising the pharmacophoric feature described herein, or derived or designed from the molecular fragments herein.

The approaches to structure-based drug design described below all require initial identification of possible compounds for interaction with the target bio-molecule (in this case integrin $\alpha_v\beta_6$). Sometimes these compounds are known e.g., from the research literature. However, when they are not, or when novel compounds are wanted, a first stage of the drug design program may involve computer-based in silico screening of compound databases (such as the Cambridge Structural Database or the Available Chemical Directory (ACD) (MDL Information Systems, San Leandro, Calif., USA) with the aim of identifying compounds which interact with the binding site or sites of the target bio-molecule. Screening selection criteria can be based on pharmacokinetic properties such as metabolic stability and toxicity or the pharmacophore of the invention. The pharmacophore can thus be used as selection criteria or filter for database screening.

Thus, as a result of the determination of the integrin $\alpha_v\beta_6$ selectivity pharmacophore more purely computational techniques for rational drug design may also be used to design anti-$\alpha_v\beta_6$ selective inhibitors (for an overview of these techniques see e.g. Walters et al, Drug Discovery Today, Vol. 3, No. 4, (1998), 160-178; Abagyan, R.; Totrov, M. Curr. Opin. Chem. Biol. 2001, 5, 375-382). For example, automated ligand-receptor docking programs (discussed e.g. by Jones et al. in Current Opinion in Biotechnology, Vol. 6, (1995), 652-656 and Halperin, I.; Ma, B.; Wolfson, H.; Nussinov, R. Proteins 2002, 47, 409-443), can be used to design potential anti-$\alpha_v\beta_6$ inhibitors on the basis of the pharmacophore described herein.

The determination of the pharmacophore for anti-$\alpha_v\beta_6$ selective inhibitors provides a basis for the design of new and specific ligands for integrin $\alpha_v\beta_6$. For example, computer modeling programs may be used to design different molecules expected to interact with binding cavities or other structural or functional features of integrin $\alpha_v\beta_6$. Examples of this are discussed in Schneider, G.; Bohm, H. J. Drug Discov. Today 2002, 7, 64-70.

More specifically, the interaction of a compound with integrin $\alpha_v\beta_6$ can be examined through the use of computer modeling using a docking program such as GOLD (Jones et al., J. Mol. Biol., 245, 43-53 (1995), Jones et al., J. Mol. Biol., 267, 727-748 (1997)), GRAMM (Vakser, I. A., Proteins, Suppl., 1:226-230 (1997)), DOCK (Kuntz et al, J. Mol. Biol. 1982, 161, 269-288, Makino et al, J. Comput. Chem. 1997, 18, 1812-1825), AUTODOCK (Goodsell et al, Proteins 1990, 8, 195-202, Morris et al, J. Comput. Chem. 1998, 19, 1639-1662.), FlexX, (Rarey et al, J. Mol. Biol. 1996, 261, 470-489) or ICM (Abagyan et al, J. Comput. Chem. 1994, 15, 488-506). This procedure can include computer fitting of compounds to integrin $\alpha_v\beta_6$ to ascertain how well the shape and the chemical structure of the compound will bind to integrin $\alpha_v\beta_6$. In addition, the pharmacophore of an anti-$\alpha_v\beta_6$ inhibitor described can allow the generation of highly predictive pharmacophore models for virtual library screening or compound design.

Also, computer-assisted, manual examination of the binding site structure of $\alpha_v\beta_6$ can be performed. The use of programs such as GRID (Goodford, J. Med. Chem., 28, (1985), 849-857)—a program that determines probable interaction sites between molecules with various functional groups and an enzyme surface—may also be used to analyse the binding cavity or cavities to predict partial structures of inhibiting compounds.

Computer programs (e.g. molecular simulation methods such as Tounge and Reynolds, J. Med. Chem., 46, (2003), 2074-2082) can be employed to estimate the attraction, repulsion, and steric hindrance of the two binding partners (i.e. integrin $\alpha_v\beta_6$ and a candidate modulator or a candidate anti-$\alpha_v\beta_6$ inhibitor). Generally the tighter the fit, the fewer the steric hindrances, and the greater the attractive forces, the more potent the potential modulator since these properties are consistent with a tighter binding constant. Furthermore, the more specificity in the design of a potential drug, the more likely it is that the drug will not interact with other proteins as well. This will tend to minimise potential side-effects due to unwanted interactions with other proteins.

In one embodiment a plurality of candidate agent compounds are screened or interrogated for interaction with the binding sites. In one example, this involves providing the structures of the candidate agent compounds, each of which is then fitted to computationally screen a database of compounds (such as the Cambridge Structural Database or ACD) for interaction with the binding sites, i.e. the candidate agent compound may be selected by computationally screening a database of compounds for interaction with the binding sites and containing the pharmacophore described herein (see the methods in Martin, J. Med. Chem., vol 35, 2145-2154 (1992)). In another example, a 3-D descriptor for the agent compound is derived where the descriptor includes the pharmacophoric feature(s) described herein. The descriptor may then be used to interrogate the compound database, the identified agent compound being the compound, which matches with the features of the descriptor.

X-ray crystallography, NMR spectroscopy, isothermal titration calorimetry (ITC), thermal denaturation, mass spectrometry and surface plasmon resonance (SPR) assays can be used in several ways for drug design. The pharmacophore described herein can be used for the design, screening, development and optimization of modulators of integrin $\alpha_v\beta_6$ (e.g., anti-$\alpha_v\beta_6$ inhibitors).

In some embodiments, the candidate anti-$\alpha_v\beta_6$ inhibitors can be identified as binding to integrin $\alpha_v\beta_6$ by using one or more of the following methods.

X-ray Crystallography.

Complexes of integrin $\alpha_v\beta_6$ (e.g., the modified integrin polypeptide dimers described herein) and a test agent can be crystallized and analyzed using X-ray diffraction methods, e.g. according to the approach described by Greer et al., J. of Medicinal Chemistry, Vol. 37, (1994), 1035-1054, and difference Fourier electron density maps can be calculated based on X-ray diffraction patterns of crystals of integrin $\alpha_v\beta_6$ or co-crystallized integrin $\alpha_v\beta_6$ and the test agent, as well as the solved structure of uncomplexed integrin $\alpha_v\beta_6$. These maps can then be analyzed e.g. to determine whether and where a particular test agent binds to the integrin $\alpha_v\beta_6$ and/or changes the conformation of integrin $\alpha_v\beta_6$.

Electron density maps can be calculated using programs such as those from the CCP4 computing package (Collaborative Computational Project 4. The CCP4 Suite: Programs for Protein Crystallography, Acta Crystallographica, D50, (1994), 760-763.). For map visualization and model building programs such as "O" (Jones et al., Acta Crystallographica, A47, (1991), 110-119) or "QUANTA" (1994, San Diego, Calif.: Molecular Simulations) can be used.

The complexes can be studied using well-known X-ray diffraction techniques and may be refined using computer software, such as CNX (Brunger et al., Current Opinion in Structural Biology, Vol. 8, Issue 5, October 1998, 606-611, and commercially available from Accelerys, San Diego, Calif.), X-PLOR (Yale University, ©1992, distributed by Accelerys), as described by Blundell et al, (1976) and Methods in Enzymology, vol. 114 & 115, H. W. Wyckoff et al., eds., Academic Press (1985).

This information can thus be used to optimize known classes of integrin $\alpha_v\beta_6$ substrates or inhibitors, and more importantly, to design and synthesize novel classes of anti-$\alpha_v\beta_6$ selective modulators, e.g., anti-$\alpha_v\beta_6$ inhibitors.

Analysing the complex by X-ray crystallography can determine the ability of the teset agent to interact with integrin $\alpha_v\beta_6$. Analysis of the co-complexes of the integrin $\alpha_v\beta_6$ may involve, e.g., phasing, molecular replacement or calculating a Fourier difference map of the complex as discussed above.

NMR Spectroscopy.

NMR spectroscopy allows for the detection of interactions between ligands and a given target protein. This technique can be applied to detect binding, by either observing the spectrum of the recombinant protein, or that of the binding ligand (Lepre, Moore & Peng, Chem. Rev. 2004, 104, 3641). The former methods are currently limited by the size of the protein, and include the so-called 'SAR by NMR' method of Shuker et al (Science 274, 1531-1534 (1996)). Methods that observe changes in the NMR properties of the ligand are not limited by the size of the protein, and again can be applied to the compounds. These include NMR methods that detect changes in ligand relaxation rates (T1 and T2/T1ρ and cross-relaxation rates, either ligand-to-ligand (NOE), protein-to-ligand (trNOE and STD-NMR) or water-to-ligand (water-LOGSY) rates, on introduction of the target protein.

For example, the WaterLOGSY experiment (Dalvit et al., J. Biomol. NMR, 118, 2000) can be used for finding compounds that bind with affinities that are generally too weak (in the 10 M to 10 mM range) to be detected by more conventional binding assays. The WaterLOGSY experiment is NOE based, with a long mixing period (ca 1.5 sec) during which magnetization can be transferred from the protein to a binding ligand. In the absence of protein or when a compound is not interacting with the protein, no magnetization can be transferred from the protein to the compound, and the rapid tumbling of the compound results in positive NOEs and negative compound signals in the NMR spectrum. On the other hand, if a compound is binding to the protein, magnetization is transferred from the protein to the compound, which, due to the slow tumbling of the protein, results in negative NOEs and positive compound signals. Interfering protein signals are not observed in the experiment, due to a large excess of compound and the suppression of protein signals. Medium throughput can be achieved by analysing mixtures of compounds. In order to identify the individual compound signals in a mixture, a reference spectrum is recorded for each compound, which can then be compared to the WaterLOGSY spectrum of the mixture. In addition, active site directed binding of a compound can be confirmed by carrying out a competition experiment with a high affinity ligand that is known to bind in the active site. Compounds binding in the active site will be displaced by the high affinity ligand, resulting in a change from positive to negative compound signals. The signals of compounds binding elsewhere on the protein or non-specifically will remain positive even in the presence of the high affinity ligand.

A typical experiment can be conducted using a 500-1000 MHz spectrometer. For each integrin $\alpha_v\beta_6$/test agent mixture a 1D reference spectrum and a WaterLOGSY spectrum is recorded. The mixtures typically contained 4-6 compounds, each at a concentration of 100-300 μM. Competition experiments are performed by adding a high affinity compound to the integrin $\alpha_v\beta_6$/test agent mixture. The WaterLOGSY spectra of integrin $\alpha_v\beta_6$/test agent mixtures in the absence and presence of the high affinity ligand are compared. A compound can be deemed an active site binder only if it could be displaced by the high affinity ligand. For each active site binder observed in a mixture, the experiment is normally repeated with the individual compound to confirm the observation.

Thus, the method can further comprise the steps of: (a) obtaining or synthesising said candidate an anti-$\alpha_v\beta_6$ inhibitor; (b) forming a complex of the integrin $\alpha_v\beta_6$ and said candidate inhibitor; and (c) analysing said complex by X-ray crystallography or NMR spectroscopy to determine the ability of said candidate inhibitor to interact with the integrin $\alpha_v\beta_6$.

Surface Plasmon Resonance (SPR).

Surface plasmon resonance (SPR) methods that can be used in ligand identification include those methods where a protein target is immobilized on the surface of the chip and candidate ligands passed over the protein in the mobile phase (Karlsson, R., Anal. Biochem., 1994, 221, 142-151; Karlsson, R., Kullman-Magnusson, M., Hamalainen, M.-D., Remaeus, A., Andersson, K., Borg, P., Gyzander, E., Deinum, J.; Analytical Biochemistry, 2000; 278, 1-13). Measurement of association and dissociation of the ligand at a range of ligand concentrations allows calculation of ligand binding affinities (reviewed in Rich & Myszka, Curr Opin Biotechnol. 11, 54-61 (2000)).

Commercial realisations of SPR allows for the detection of interactions between ligand and target protein in real time. Monitoring of protein/ligand interactions is done with an optical detection system based on surface plasmon resonance (SPR). In order to measure the interaction between ligand and protein one of the components must be covalently attached to the surface of a sensor chip. This chip is composed of a glass slide with a thin layer of gold deposited on one side and a matrix such as dextran covering the gold surface. The phenomenon of SPR occurs when light is reflected from a conducting film that is sandwiched between two non-absorbing media. The conducting film is the gold layer of the chip and the two media of different refractive index are the glass slide and the aqueous sample flowing over the surface of the chip. Surface plasmon resonance causes a decrease in intensity of the reflected light at a specific angle. The angle at which the decrease occurs is sensitive to the mass of solutes at the surface of the chip. When molecules bind to the surface of the chip the mass increases affecting the angle at which the decrease in intensity occurs. For example, a ligand attached to the chip surface would bind the target protein and increase the mass at the chip surface.

In a typical experiment, integrin $\alpha_v\beta_6$/inhibitor interaction can be assayed by attaching a high affinity binder to the surface of a sensor chip. The presence of an anti-$\alpha_v\beta_6$ inhibitor reduces the signal by binding to the integrin $\alpha_v\beta_6$ and inhibiting the interaction with the high affinity binder on the chip. An anti-$\alpha_v\beta_6$ inhibitor can thus be detected.

Thus, the method of the invention may comprise the further steps of: (a) obtaining or synthesising said candidate anti-$\alpha_v\beta_6$ inhibitor; (b) forming a complex of integrin $\alpha_v\beta_6$ described herein (e.g., the modified integrin polypeptide dimers described herein) and said candidate inhibitor; and (c) analyzing said complex by SPR assay to determine the ability of said candidate inhibitor to interact with integrin $\alpha_v\beta_6$.

ITC and Thermal Denaturation.

Isothermal titration calorimetry (ITC) can be used as an alternative method to detect the interaction between integrin $\alpha_v\beta_6$ and a candidate ligand. Again various methods have been described, including direct titration of a protein solution with the ligand of interest and measurement of the associated enthalpy changes (reviewed in Leavitt & Friere, Curr. Opin. Struct. Biol. 11, 560-566 (2001)), low c-value methods for weak-binding ligands (Tumbull & Daranas, J Am Chem Soc. 125, 14859-66 (2003)), and competition methods for weak-binding ligands (Zhang & Zhang, Curr Opin Biotechnol. 11, 54-61 (2000)) and extremely tight-binding ligands (Velazquez-Campoy, A., Kiso, Y., Freire, E. Arch. Biochem. Biophys. 390, 169-175 (2001).

In addition to ITC, differential scanning calorimetry (DSC) is another calorimetric method that can be used to identify protein ligands. This DSC method measures the effect of ligands upon the thermal denaturation mid-point of a target protein (Plotinov et al, Assay & Drug Development Technologies 1, 83-89 (2002)). Thermal denaturation methods take advantage of the observed energetic coupling between protein stability and ligand binding, thus allowing identification of ligands through their ability to stabilise the protein. This effect can be measured in several other ways, for example by using a fluorescent reporter dye to measure changes in the temperature at which thermal denaturation occurs (Pantoliano et al, J. Biomol. Screening 6, 429-440 (2001)) or by using a fluorescent reporter dye to measure the ability of candidate ligands to alter the rate at which thermal denaturation occurs (Epps et al, Anal. Biochem. 292, 40-50 (2001)).

Thus, the method can comprise further comprise the steps of: (a) obtaining or synthesising said candidate anti-$\alpha_v\beta_6$ inhibitor; (b) forming a complex of integrin $\alpha_v\beta_6$ (e.g., the modified integrin polypeptide dimers described herein) and said candidate inhibitor; and (c) analyzing said complex by thermal denaturation or ITC to determine the ability of said candidate inhibitor to interact with integrin $\alpha_v\beta_6$.

Mass Spectrometry.

There are different mass spectrometry methods that have been used to detect ligand binding to proteins. In one method, the protein is exposed to a mixture of ligands in solution. Protein-ligand complexes are then separated from unbound ligands by a chromatographic method and the ligands identified by mass spectrometry after dissociation of the complex (F J Moy, K Haraki, D Mobilio, G Walker, R Powers, K Tabei, H Tong, M M Siegel, Anal Chem 2001, 73, 571-581). In another method, the protein is exposed to single ligand or a mixture of ligands in solution. Protein-ligand complexes are detected directly by obtaining mass spectra of the complex under conditions where association of the ligand is maintained in the mass spectrometer and the identity of the ligand is determined by analysis of the mass of the complex (E E Swayze, E A Jefferson, K A Sannes-Lowery, L B Blyn, L M Risen, S Arakawa, S A Osgood, S A Hofstadler and R H Griffey, J. Med. Chem. 2002, 45, 3816-3819). In an alternative method, ligand binding to the protein is detected via a change in the rate of hydrogen-deuterium exchange when the protein is exposed to deuterate solvents in the presence and absence of a ligand. Various experimental schemes are possible which measure global or local changes in exchange caused by the presence of a ligand (K D Powell, S Ghaemmaghami, M Z Wang, L Ma, T G Oas and M C Fitzgerald JACS 2002, 124, 10256-10257; M M Zhu, D L Rempel, Z Du, M L Gross, JACS 2003, 125, 5253-5253).

By introducing at least one disulfide bond to an integrin dimer, the interaction between the integrin α subunit and the integrin β subunit, unlike the wild-type integrin dimer, is irreversible, and thus crystal structure of the disulfide-linked integrin dimer can be formed with a high resolution, which can then used for various applications, e.g., pharmacophore modeling, and/or drug screening. Accordingly, in another aspect, provided herein is a method of identifying an anti-$\alpha_v\beta_6$ inhibitor. The method comprises: (a) providing or generating, on a computer, a three-dimensional structure of $\alpha_v\beta_6$ integrin protein or a portion thereof characterized by atomic structure coordinates (e.g., as described in Table 6 of, Application No. 62/033,699 or a three-dimensional structure that exhibits a root-mean-square difference (rmsd) in α-carbon positions of less than 2.0 Å (or less than 1.0 Å) with the atomic structure coordinates (e.g., as described in Table 6 of PCT Application No: PCT/US15/44093 filed Aug. 6, 2015); (b) docking on the computer a first molecular entity in a first part of a binding pocket of the integrin $\beta_6$ headpiece polypeptide having an amino acid sequence of SEQ ID NO: 2, to determine the binding association between the first molecular entity and the first part of the binding pocket, wherein the binding pocket comprises amino acid residues Ala-217, Asn-218, Pro-179, Cys-180, Ile-183, Ala-126, and Tyr-185; (c) docking on the computer a second molecular entity in a second part of the binding pocket, to determine the binding association between the second molecular entity and the second part of the binding pocket; (d) repeating steps (b) to (c) with a different first and second molecular entity; (e) selecting a first and a second chemical entity based on the quantified binding associations; and (f) generating on the computer a pharmacophore model by assembling the selected first and second molecular entity into a molecular representation that interacts with the binding pocket.

In another aspect, a method of identifying an anti-$\alpha_v\beta_3$ inhibitor is also provided herein. The method comprises: (a) providing, on a computer, a three-dimensional crystalline structure of $\alpha_v\beta_3$ integrin protein or a portion thereof characterized by its atomic structure coordinates (e.g., as described in Table 8 of PCT Application No: PCT/US15/44093 filed Aug. 6, 2015), or a three-dimensional structure that exhibits a root-mean-square difference (rmsd) in α-carbon positions of less than 2.5 Å (or less than 2.0 Å, or less than 1.0 Å) with its atomic structure coordinates (e.g., as described in Table 8 of PCT Application No: PCT/US15/44093 filed Aug. 6, 2015); (b) docking on the computer a first molecular entity in a first part of a binding pocket of the integrin $\beta_3$ headpiece polypeptide having an amino acid sequence of SEQ ID NO: 5 or a fragment thereof (with desired domain(s)), to determine the binding association between the first molecular entity and the first part of the binding pocket; (c) docking on the computer a second molecular entity in a second part of the binding pocket, to determine the binding association between the second molecular entity and the second part of the binding pocket; (d) repeating steps (b) to (c) with a different first and second molecular entity; (e) selecting a first and a second chemical entity based on the quantified binding associations; and (f) generating on the computer a pharmacophore model by assembling the selected first and second molecular entity into a molecular representation that interacts with the binding pocket.

As used herein, the term "molecular entity" refers to an atom, a molecule, or a chemical functional group. Various molecular entities are known in the art, including, e.g., but not limited to, hydrophobic moieties, acidic moieties, basic moieties, polar moieties, non-polar moieties, negatively-charged moieties, positively-charged moieties, and any combinations thereof, and can be used in the docking analysis to determine a pharmacophore model. Non-limiting examples of molecular entities include hydrogen, alkyl, aryl, halogen, hydroxyl, amino, alkoxy, alcohol, benzyl, phenyl, nitro, thiol, thioalkoxy, alkenyl, alkynyl, keto, carobyl, amide, amidine, guanidine, glutamyl, nitrate, nitro, nitrile, azido, sulfide, disulfide, sulfone, sulfoxide, and any combinations thereof.

As used herein, the term "docking" refers to manipulation or placement of a molecular entity in a binding pocket. For example, docking can include orienting, rotating, translating a molecular entity in a binding pocket, domain, molecule or molecular complex or portion thereof based on distance geometry and/or energy. In some embodiments, docking can be performed by distance geometry methods that find sets of atoms of a molecular entity that match sets of sphere centers of the binding pocket, domain, molecule or molecular complex or portion thereof. See Meng et al. J. Comp. Chem. 4: 505-524 (1992). Sphere centers are generated by providing an extra radius of given length from the atoms (excluding hydrogen atoms) in the binding pocket, domain, molecule or molecular complex or portion thereof. Real-time interaction energy calculations, energy minimizations or rigid-body minimizations (Gschwend et al., J. Mol. Recognition 9:175-186 (1996)) can be performed while orienting the chemical entity to facilitate docking. For example, interactive docking experiments can be designed to follow the path of least resistance. If the user in an interactive docking experiment makes a move to increase the energy, the system will resist that move. However, if that user makes a move to decrease energy, the system will favor that move by increased responsiveness. (Cohen et al., J. Med. Chem. 33:889-894 (1990)). Docking can also be performed by combining a Monte Carlo search technique with rapid energy evaluation using molecular affinity potentials. See Goodsell and Olson, Proteins: Structure, Function and Genetics 8:195-202 (1990). Software programs that carry out docking functions include but are not limited to MATCHMOL (Cory et al., J. Mol. Graphics 2: 39 (1984); MOLFIT (Redington, Comput. Chem. 16 217 (1992)) and DOCK (Meng et al., supra).

The term "providing or generating a three-dimensional structure" as used herein refers to converting a list of atomic structure coordinates into a structural model or graphical representation in a three-dimensional space. This can be achieved, for example, through commercially or publicly available software. A model of a three-dimensional structure of a molecule or molecular complex can thus be constructed on a computer that contains the atom structure coordinates of a desired molecule or molecular complex and appropriate software. The three-dimensional structure can be displayed or used to perform computer modeling or fitting or docking operations. In some embodiments, the atomic structure coordinates themselves, without the displayed model, can be used to perform computer-based modeling and/or fitting or docking operations.

As used herein, the term "binding association" refers to a measure of shape complementarity between a molecular entity and at least part of a binding pocket, which is correlated with a superimposition between all or part of the atoms of a molecular entity and/or all or part of the atoms of a ligand bound in a binding pocket of a molecule of interest. In some embodiments, the docking process can be be facilitated by RMSD values and/or calculations of distance geometry and/or energy. Energy can include but is not limited to interaction energy, free energy and deformation energy. See Cohen, supra. For example, if a molecular entity moves to an orientation with a high RMSD, the system will resist the motion.

The term "root mean square deviation" or "RMSD" means the square root of the arithmetic mean of the squares of the deviations from the mean. It is a way to express the deviation or variation from a trend or object. For purposes of pharmacophore modeling, the "root mean square deviation" defines the variation in the backbone atoms of an integrin heterodimer, e.g., for integrin $\alpha_v\beta_6$, a binding pocket, a headpiece a motif, a domain, or portion thereof, as defined by the atomic structure coordinates of a crystal structure of integrin $\alpha_v\beta_6$ (e.g., described in Table 6 of PCT Application No: PCT/US15/44093 filed Aug. 6, 2015, or for integrin $\alpha_v\beta_3$, a binding pocket, a headpiece a motif, a domain, or portion thereof, as defined by the atomic structure coordinates of a crystal structure of integrin $\alpha_v\beta_3$ (e.g., as described in Table 8 of PCT Application No: PCT/US15/44093 filed Aug. 6, 2015). It would be apparent to a skilled artisan that the calculation of RMSD involves a standard error of ±0.1 Å.

After determining a possible candidate anti-$\alpha_v\beta_6$ inhibitor or anti-$\alpha_v\beta_3$ inhibitor from a pharmacophore model, the method of this aspect and other aspects described herein can further comprise the steps of: (a) obtaining or synthesising said candidate anti-$\alpha_v\beta_6$ inhibitor or anti-$\alpha_v\beta_3$ inhibitor; (b) forming a complex of integrin $\alpha_v\beta_6$ or $\alpha_v\beta_3$ and said candidate inhibitor; and (c) analyzing said complex by mass spectrometry to determine the ability of said candidate modulator to interact with integrin $\alpha_v\beta_6$ or $\alpha_v\beta_3$.

In some embodiments, the method can further comprise contacting the candidate anti-integrin inhibitor (e.g., anti-$\alpha_v\beta_6$ inhibitor or anti-$\alpha_v\beta_3$ inhibitor) with an integrin protein (e.g., an $\alpha_v\beta_6$ integrin protein or an $\alpha_v\beta_3$ integrin protein) to determine the ability of the candidate anti-integrin inhibitor (e.g., anti-$\alpha_v\beta_6$ integrin inhibitor or anti-$\alpha_v\beta_3$ inhibitor) to bind the corresponding integrin protein (e.g., $\alpha_v\beta_6$ integrin protein or $\alpha_v\beta_3$ integrin protein).

In some embodiments, biological assays or cells assays can be performed to determine the ability of the anti-integrin inhibitor (e.g., anti-$\alpha_v\beta_6$ integrin inhibitor or anti-$\alpha_v\beta_3$ integrin inhibitor) to bind the corresponding integrin protein (e.g., $\alpha_v\beta_6$ integrin protein or $\alpha_v\beta_3$ integrin protein). For example, the method can further comprise contacting cells of interest with the candidate anti-integrin inhibitor (e.g., anti-$\alpha_v\beta_6$ inhibitor or anti-$\alpha_v\beta_3$ inhibitor) and detecting the response of the cells, e.g., biological properties associated with integrin signaling (e.g., $\alpha_v\beta_6$ or $\alpha_v\beta_3$ integrin signaling), e.g., but not limited to cell adhesion, migration potential, cell viability, production of cytokines, cell morphology, and any combinations thereof.

Following identification of anti-integrin inhibitors (e.g., anti-$\alpha_v\beta_6$ inhibitors or anti-($\alpha_v\beta_3$ inhibitors) using the pharmacophore model described herein, the inhibitors can be manufactured and/or used in the preparation, i.e. manufacture or formulation, of a composition such as a medicament, pharmaceutical composition or drug. These can be administered to individuals who are in need thereof.

The methods described herein to identify a ligand for an integrin $\alpha_v\beta_6$ heterodimer or an anti-$\alpha_v\beta_6$ inhibitor can be extended to identify a ligand or an inhibitor for other integrin $\alpha\beta$ heterodimers, e.g., $\alpha_v\beta_3$ or $\alpha_v\beta_8$ heterodimers. For example, a pharmacophore of a ligand or an inhibitor for other integrin $\alpha\beta$ heterodimer can be designed on the identification of a binding pocket of the crystal structure of the corresponding modified integrin polypeptide dimer described herein.

Crystalline Compositions

In a further aspect, provided herein is a crystalline composition comprising a ligand-binding headpiece of integrin $\alpha_v\beta_6$, wherein the crystalline composition is characterized with space group C2, and has unit cell parameters a=184.5±3 Å, b=168.3±3 Å, c=101.8±3 Å, $\alpha=\beta=90°$, and $\gamma=98.2°+3°$.

In some embodiments, the crystalline composition can further comprise a ligand. Accordingly, a crystalline composition comprising a ligand-binding headpiece of integrin $\alpha_v\beta_6$ and a ligand is also provided herein. The crystalline composition is characterized with space group C2, and has unit cell parameters a=184.4±3 Å, b=170.0±3 Å, c=102.4±3 Å, $\alpha=\beta=90°$, and $\gamma=98.7°±3°$.

In some embodiments, the ligand-binding headpiece of integrin $\alpha_v\beta_6$ can comprise a modified integrin $\alpha_v$ headpiece polypeptide described herein, and a modified integrin $\beta_6$ headpiece polypeptide described herein.

In some embodiments, the crystalline composition has a binding pocket in the modified integrin $\beta_6$ headpiece polypeptide, wherein the binding pocket comprises amino acid residues Ala-217, Asn-218, Pro-179, Cys-180, Ile-183, Ala-126, and Tyr-185.

In some embodiments, the ligand-binding headpiece of integrin $\beta_6$ can be described by its atomic structure coordinates (e.g., described in Table 6 of PCT Application No: PCT/US15/44093 filed Aug. 6, 2015), or a structure that exhibits a root-mean-square difference (rmsd) in $\alpha$-carbon positions of less than 2.0 Å (or less than 1.0 Å) with its atomic structure coordinates In some embodiments where the crystalline composition further comprises a ligand, e.g., a peptide, the crystalline composition can be described by its atomic structure coordinates (e.g., described in Table 7 of PCT Application No: PCT/US15/44093 filed Aug. 6, 2015), or a structure that exhibits a root-mean-square difference (rmsd) in $\alpha$-carbon positions of less than 2.0 Å (or less than 1.0 Å) with its atomic structure coordinates.

A crystalline composition comprising a ligand-binding headpiece of integrin $\alpha_v\beta_3$ is also provided herein. The crystalline composition is characterized with space group P22121, and has unit cell parameters a=87±2 Å, b=124±2 Å, c=165±2 Å, $\alpha=\beta=90°$, and $\gamma=90°±3°$. In some embodiments, the ligand-binding headpiece of integrin $\alpha_v\beta_3$ can comprise a modified integrin $\alpha_v$ headpiece polypeptide described herein, and a modified integrin $\beta_3$ headpiece polypeptide described herein. In some embodiments, the ligand-binding headpiece of integrin $\alpha_v\beta_3$ can be described by its atomic structure coordinates (e.g., as described in Table 8 of PCT Application No: PCT/US15/44093 filed Aug. 6, 2015), or a structure that exhibits a root-mean-square difference (rmsd) in $\alpha$-carbon positions of less than 2.5 Å (or less than 2.0 Å, or less than 1.0 Å) with its atomic structure coordinates (e.g., as described in Table 8 of PCT Application No: PCT/US15/44093 filed Aug. 6, 2015).

Another aspect provided herein relates to a crystalline composition comprising a ligand-binding headpiece of integrin $\alpha_v\beta_8$. The ligand-binding headpiece of integrin $\alpha_v\beta_8$ is characterized with space group P1, and has unit cell parameters a=153±3 Å, b=55±3 Å, c=181±3 Å, $\alpha=\beta=90°$, and $\gamma=110°±30$. In some embodiments, the ligand-binding headpiece of integrin $\alpha_v\beta_8$ can comprise a modified integrin $\alpha_v$ headpiece polypeptide described herein, and a modified integrin $\beta_8$ headpiece polypeptide described herein.

In some embodiments of various aspects described herein, the crystalline composition can be formed from a crystallization solution buffered between pH 6-8 at a temperature of about 20° C. or at room temperature, and having an ionic strength of about 800-900 mM.

As used herein, the term "crystallization solution" refers to a solution which promotes crystallization comprising at least one agent, e.g., but not limited to a buffer, one or more salts, a precipitating agent, one or more detergents, sugars or organic compounds, lanthanide ions, a poly-ionic compound, a stabilizer, or any combinations thereof.

In some embodiments, the crystallization solution for forming integrin $\alpha_v\beta_6$ headpiece can comprise 20 mM Tris-HCl pH 8.0, 150 mM NaCl, 1 mM CaCl$_2$) and 1 mM MgCl$_2$ buffer (1 µl) and 1 µl reservoir solution of 20% PEG 4000, 0.1 M sodium cacodylate pH 6.0, 0.2 M ammonium sulfate.

The crystalline compositions can be used for various applications, including, e.g., drug screening or pharmacophore modeling. Thus, for example, in one aspect, a method of identifying an anti-$\alpha_v\beta_8$ inhibitor is also provided herein. The method comprises: (a) providing, on a computer, a three-dimensional crystalline structure of $\alpha_v\beta_8$ integrin protein or a portion thereof derived from the crystalline composition comprising a ligand-binding headpiece of integrin $\alpha_v\beta_8$ described herein; (b) docking on the computer a first molecular entity in a first part of a binding pocket of the integrin $\beta_8$ headpiece polypeptide having an amino acid sequence of SEQ ID NO: 6 or a fragment thereof (e.g., with desired domain(s)), to determine the binding association between the first molecular entity and the first part of the binding pocket; (c) docking on the computer a second molecular entity in a second part of the binding pocket, to determine the binding association between the second molecular entity and the second part of the binding pocket; (d) repeating steps (b) to (c) with a different first and second molecular entity; (e) selecting a first and a second chemical entity based on the quantified binding associations; and (f) generating on the computer a pharmacophore model by assembling the selected first and second molecular entity into a molecular representation that interacts with the binding pocket. In some embodiments, the method can further comprise contacting the candidate anti-$\alpha_v\beta_8$ inhibitor (based on the pharmacophore model) with an $\alpha_v\beta_8$ integrin protein to determine the ability of the candidate anti-$\alpha_v\beta_8$ integrin inhibitor to bind the $\alpha_v\beta_8$ integrin protein. While the method in this aspect is directed to identifying an anti-$\alpha_v\beta_8$ inhibitor, the same method can be used to identify other anti-integrin inhibitor (e.g., anti-$\alpha_v\beta_3$ inhibitor or anti-$\alpha_v\beta_6$ inhibitor) with the appropriate crystalline compositions described herein.

Applicants have provided the crystal structure coordinates for integrin $\alpha_v\beta_6$ in Table 6 of PCT Application No: PCT/US15/44093 filed Aug. 6, 2015 including, (a) "ATOM" records, which lists the amino acid residues in integrin $\alpha_v\beta_6$ headpiece and their atomic structure coordinates in a three-dimensional space characterized by x, y, and z coordinates; (b) "ANISOU" records, which present the anisotropioc temperature factors relating to the corresponding ATOM isotropic temperature factors as b-factor (e.g., in column 11 of "ATOM" records in Table 6 of PCT Application No: PCT/US15/44093 filed Aug. 6, 2015); and (c) "HETATM" records, which provide the atomic coordinate records for atoms within "non-standard" groups, e.g., water molecules and atoms presented in heterogen groups such as prosthetic groups, inhibitors, solvent molecules, and ions. SEQ ID NOS 115-121 are disclosed herein and Table 6 of PCT Application No: PCT/US15/44093 filed Aug. 6, 2015, respectively, in order of appearance.

Applicants have provided the crystal structure coordinates for integrin $\alpha_v\beta_6$ headpiece and a peptide in Table 7 of PCT Application No: PCT/US15/44093 filed Aug. 6, 2015 including, (a) "ATOM" records, which lists the amino acid residues in a complex comprising an integrin $\alpha_v\beta_6$ headpiece and a peptide, and their atomic structure coordinates in a three-dimensional space characterized by x, y, and z coordinates; (b) "ANISOU" records, which present the anisotropioc temperature factors relating to the corresponding ATOM isotropic temperature factors as b-factor (e.g., in column 11 of "ATOM" records in Table 7 of PCT Application No: PCT/US15/44093 filed Aug. 6, 2015; and (c) "HETATM" records, which provide the atomic coordinate records for atoms within "non-standard" groups, e.g., water molecules and atoms presented in heterogen groups such as prosthetic groups, inhibitors, solvent molecules, and ions. The anisotropic temperature factors are stored in the same coordinate frame as the atomic coordinate records. SEQ ID NOS 115-120, 122-128, 121, and 78, are disclosed herein and Table 7 of PCT Application No: PCT/US15/44093 filed Aug. 6, 2015 respectively, in order of appearance.

Applicants have provided the crystal structure coordinates for $\alpha\alpha_v\beta_3$ in Table 8 of PCT Application No: PCT/US15/44093 filed Aug. 6, 2015, including, (a) "ATOM" records, which lists the amino acid residues in an integrin $\alpha_v\beta_3$ headpiece, and their atomic structure coordinates in a three-dimensional space characterized by x, y, and z coordinates; (b) "ANISOU" records, which present the anisotropioc temperature factors relating to the corresponding ATOM isotropic temperature factors as b-factor in column 11 of "ATOM" records in (e.g., Table 8 of PCT Application No: PCT/US15/44093 filed Aug. 6, 2015); and (c) "HETATM" records, which provide the atomic coordinate records for atoms within "non-standard" groups, e.g., water molecules and atoms presented in heterogen groups such as prosthetic groups, inhibitors, solvent molecules, and ions. The anisotropic temperature factors are stored in the same coordinate frame as the atomic coordinate records. Additional information about the coordinate record description (e.g., Tables 6-7 of PCT Application No: PCT/US15/44093 filed Aug. 6, 2015 in PDB format) can be accessed online at RCSB protein data bank website, which is incorporated herein by reference in their entireties. SEQ ID NOS 129-130 are disclosed herein and Table 8 of PCT Application No: PCT/US15/44093 filed Aug. 6, 2015, respectively, in order of appearance.

Different protein chains are specified by the "TER" keyword, as well as a one-letter designation in the coordinate records (see column 22: Chain ID). The chains are included one after another separated by a TER record to indicate that the chains are not physically connected to each other, i.e., no covalent bond connecting different chains.

The b-factor or temperature factor is a value to account for distribution of electrons in a non-ideal situation, e.g., due to vibration of atoms or differences between the many different molecules in a crystal lattice, which yields a slightly smeared image of the molecule. The amount of smearing is proportional to the magnitude of the b-factor. Thus, b-factor can be a measure of confidence in the location of each atom or molecule. Values under 10 generally create a model of the atom that is very sharp, indicating that the atom is not moving much and is in the same position in all of the molecules in the crystal. Values greater than 50 or so generally indicate that the atom is moving so much that it can barely been seen. For example, in the case with atoms at the surface of proteins, long sidechains are free to wag in the surrounding. These atoms generally have high b-factor, and their coordinates e.g., as specified in Table 6 of PCT Application No: PCT/US15/44093 filed Aug. 6, 2015, may represent only one possible snapshot of its location.

Macromolecular crystals are composed of many individual molecules packed into a symmetrical arrangement. The term "occupancy" as used in "ATOM" records provides an estimation of the number of conformations of each amino acid residue observed in a crystal lattice. An occupancy value of about 1 indicates that the amino acid residue is found at the same place of all of the molecules packed into the crystal.

Kits for Performing Various Aspects of the Methods Described Herein

Kits comprising materials for performing methods according to various aspects described herein are also provided herein. A kit can be in any configuration well known to those of ordinary skill in the art and can be used to perform one or more of the methods described herein, e.g., for forming a modified integrin polypeptide dimer (e.g., for identifying a binding site or pocket for a ligand), determining whether a test agent forms a complex with an integrin heterodimer, and/or determining binding affinity of a test agent to an integrin heterodimer.

In one aspect, the kit comprises, consists essentially of, or consists of either one or both of the modified integrin α and β headpiece polypeptides or functional fragments/variants described herein (e.g., but not limited to the modified integrin $α_v$ headpiece polypeptides described herein, and/or the modified integrin $β_6$ headpiece polypeptides described herein), and at least one reagent and/or purification device (e.g., one or more standard protein purification columns). In some embodiments, the kit can comprise, consist essentially of, or consist of at least one of the modified integrin α headpiece polypeptides described herein or a functional fragment thereof, at least one of the modified integrin β headpiece polypeptides described herein or a functional fragment thereof, and at least one reagent. In some embodiments, the kit can comprise, consist essentially of, or consist of at least two or more different modified integrin α headpiece polypeptides described herein or functional fragments thereof, at least two or more modified integrin β headpiece polypeptides described herein or a functional fragments thereof, and at least one reagent. By providing different modified integrin α and/or β headpiece polypeptides or functional fragments thereof, different modified integrin polypeptide dimers can be produced according to a user's need.

In some embodiments, the reagent included in the kit can be any materials or solutions to form a modified integrin polypeptide dimer therein. For example, the reagent can comprise a buffered solution, e.g., suitable for forming a modified integrin polypeptide dimer therein.

In some embodiments, the kit can further comprise packaging materials and instructions for forming a modified integrin polypeptide dimer from the modified integrin α and/or β headpiece polypeptides provided in the kit.

In another aspect, the kit comprises, consists essentially of, or consists of at least one or more modified integrin polypeptide dimers described herein, e.g., the modified integrin $α_vβ_6$ dimer described herein, and and at least one reagent. In some embodiments, the kit can be used to identify a binding site or pocket for a ligand or an inhibitor. In some embodiments, the kit can be used to determine whether a test agent of a user's choice forms a complex with an integrin heterodimer. In some embodiments, the kit can be used to determine binding affinity of a test agent of a user's choice to an integrin heterodimer. In some embodiments, the kit can be used to identify a ligand or an inhibitor for the modified integrin polypeptide dimers described herein.

In some embodiments, the kit can comprise at least two or more different modified integrin polypeptide dimers described herein, including, but not limited to, the modified integrin $α_vβ_6$ dimer described herein, and the modified integrin $α_vβ_3$ dimer described herein, and and at least one reagent. In these embodiments, the kit can also be used to characterize effects of a test agent on more than one integrin heterodimers. For example, the kit can be used to determine the specificity of a test agent to interact with an integrin heterodimer.

In some embodiments, the reagent included in the kit of this aspect can be any materials or solutions suitable to maintain the biological activity of the modified integrin polypeptide dimers included in the kit and/or to perform downstream applications as noted above. For example, the reagent can comprise a buffered solution, e.g., suitable for performing crystallization of a modified integrin headpiece polypeptide described herein (complexed with or without a test agent) and detecting the crystal structure by X-ray crystallography, fluorescence anisotropy, and/or flow cytometry. Reagents and/or materials commonly used in detecting a protein crystal structure by X-ray crystallography, fluorescence anisotropy, and/or flow cytometry are known in the art and can be included in the kit described herein.

In some embodiments, the kit can further comprise packaging materials and instructions for performing crystallization of a modified integrin polypeptide dimer described herein (complexed with or without a test agent) and detecting the crystal structure by X-ray crystallography. In some embodiments, the kit can further comprise packaging materials and instructions for determining integrin heterodimer-test agent interaction (including, e.g., formation of an integrin heterodimer-test agent complex, and/or measurement of a binding affinity of a test agent to a modified integrin polypeptide dimer described herein), for example, by performing fluorescence anisotropy, and/or flow cytometry.

In some embodiments, the kit can further comprise at least one or more competing agent described herein.

In various aspects of the kits described herein, the modified integrin α or β headpiece polypeptides described herein, and/or the modified integrin polypeptide dimers described herein can be present in particles, lyophilized powder, solution, or suspension.

In some embodiments of various aspects described herein, the modified integrin headpiece polypeptides and/or the modified integrin polypeptide dimers included in the kit can be attached to a solid surface. Depending on the need of desired applications, the solid surface can be made of any material, including, but are not limited to, glass, silicone, cellulose-based materials (e.g., paper), plastics, polymer, and/or any combinations thereof. In some embodiments, the kit can further comprise a microtiter plate, wherein each well of the microtiter plate is coated with at least one or more of the modified integrin polypeptides and/or the modified integrin polypeptide dimers described herein.

In all such embodiments of various aspects described herein, the kit includes the necessary packaging materials and informational material therein to use said kits. The informational material can be descriptive, instructional, marketing or other material that relates to the methods described herein and/or the use of a compound(s) described herein for the methods described herein. In one embodiment, the informational material can include information about production and/or molecular weight of the modified integrin headpiece polypeptides or modified integrin polypeptide dimers described herein, concentration, date of expiration, batch or production site information, and so forth. In one embodiment, the informational material relates to methods for forming a modified integrin polypeptide dimer and/or a crystal structure thereof. In one embodiment, the informational material can include instructions to form a modified integrin polypeptide dimer and/or a crystal structure thereof in a suitable manner to perform the methods described herein, e.g., for identifying a binding site or pocket for a ligand, determining whether a test agent forms a complex with an integrin heterodimer, and/or determining binding affinity of a test agent to an integrin heterodimer.

The informational material of the kits is not limited in its form. In many cases, the informational material, e.g., instructions, is provided in printed matter, e.g., a printed text, drawing, and/or photograph, e.g., a label or printed sheet. However, the informational material can also be provided in other formats, such as Braille, computer readable material, video recording, or audio recording. In another embodiment, the informational material of the kit is contact information, e.g., a physical address, email address, website, or telephone number, where a user of the kit can obtain substantive information about a compound described herein and/or its use in the methods described herein. Of course, the informational material can also be provided in any combination of formats.

In all embodiments of the aspects described herein, the kit will typically be provided with its various elements included in one package, e.g., a fiber-based, e.g., a cardboard, or polymeric, e.g., a styrofoam box. The enclosure can be configured so as to maintain a temperature differential between the interior and the exterior, e.g., it can provide insulating properties to keep the reagents at a preselected temperature for a preselected time. The kit can include one or more containers for the composition containing a compound(s) described herein. In some embodiments, the kit contains separate containers (e.g., two separate containers for the two agents), dividers or compartments for the composition(s) and informational material. For example, the composition can be contained in a bottle, vial, or syringe, and the informational material can be contained in a plastic sleeve or packet. In other embodiments, the separate elements of the kit are contained within a single, undivided container. For example, the composition is contained in a bottle, vial or syringe that has attached thereto the informational material in the form of a label. In some embodiments, the kit includes a plurality (e.g., a pack) of individual containers, each containing one or more unit dosage forms (e.g., a dosage form described herein) of a compound described herein. For example, the kit includes a plurality of syringes, ampules, foil packets, or blister packs, each containing a single unit dose of a compound described herein. The containers of the kits can be air tight, waterproof (e.g., impermeable to changes in moisture or evaporation), and/or light-tight.

Exemplary Methods for Producing the Modified Integrin α Headpiece Polypeptides, Modified Integrin β Headpiece Polypeptides, Modified Integrin Polypeptide Dimers Described Herein The modified integrin at headpiece polypeptides, modified integrin β headpiece polypeptides, and/or modified integrin polypeptide dimers described herein can be produced by any protein modifications and/or DNA recombinant methods known in the art. For example, by engineering a cell to comprise a nucleic acid, e.g., an isolated nucleic acid, encoding a modified integrin α headpiece polypeptide described herein and/or a modified integrin β headpiece polypeptide described herein; culturing the cell under conditions suitable for the production of the modified polypeptides; and isolating and/or purifying the modified polypeptides, e.g., by affinity purification, various modified integrin α headpiece polypeptides, modified integrin β headpiece polypeptides, and/or modified integrin polypeptide dimers described herein can be produced, e.g., for use in the methods described herein, and/or for inclusion in the kits described herein.

Nucleic acid molecules encoding a modified integrin α headpiece polypeptide described herein and/or a modified integrin β headpiece polypeptide described herein can be prepared by a variety of methods known in the art. These methods include, but are not limited to, PCT, ligation, and direct synthesis. A nucleic acid sequence encoding a polypeptide as described herein can be recombined with vector DNA in accordance with conventional techniques, including blunt-ended or staggered-ended termini for ligation, restriction enzyme digestion to provide appropriate termini, filling in of cohesive ends as appropriate, alkaline phosphatase treatment to avoid undesirable joining, and ligation with appropriate ligases. Techniques for such manipulations are disclosed, e.g., by Maniatis et al., Molecular Cloning, Lab. Manual (Cold Spring Harbor Lab. Press, N Y, 1982 and 1989), and Ausubel, 1987, 1993, and can be used to construct nucleic acid sequences which encode a heme-binding molecule and/or composition polypeptide as described herein.

The term "vector" encompasses any genetic element that is capable of replication when associated with the proper control elements and that can transfer gene sequences to cells. A vector can include, but is not limited to, a cloning vector, an expression vector, a plasmid, phage, transposon, cosmid, chromosome, virus, virion, etc. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., Proc. Natl. Acad. Sci. USA (1995) 92:1292).

In one aspect, provided herein is an expression vector comprising a nucleic acid encoding a modified integrin α headpiece polypeptide described herein and/or a modified integrin β headpiece polypeptide described herein. Such vectors can be used, e.g. to transform a cell in order to produce the encoded polypeptide. As used herein, the term "expression vector" refers to a vector that directs expression of an RNA or polypeptide from sequences linked to transcriptional regulatory sequences on the vector. The sequences expressed will often, but not necessarily, be heterologous to the cell. An expression vector may comprise additional elements, for example, the expression vector may have two replication systems, thus allowing it to be maintained in two organisms, for example in mammalian cells for expression and in a prokaryotic host for cloning and amplification. The term "expression" refers to the cellular processes involved in producing RNA and proteins and as appropriate, secreting proteins, including where applicable, but not limited to, for example, transcription, transcript processing, translation and protein folding, modification and processing. "Expression products" include RNA transcribed from a gene, and polypeptides obtained by translation of mRNA transcribed from a gene. The term "gene" means the nucleic acid sequence, which is transcribed (DNA) to RNA in vitro or in vivo when operably linked to appropriate regulatory sequences. The gene may or may not include regions preceding and following the coding region, e.g. 5' untranslated (5'UTR) or "leader" sequences and 3' UTR or "trailer" sequences, as well as intervening sequences (introns) between individual coding segments (exons).

Examples of vectors useful in delivery of nucleic acids encoding isolated peptides as described herein include plasmid vectors, non-viral plasmid vectors (e.g. see U.S. Pat. Nos. 6,413,942, 6,214,804, 5,580,859, 5,589,466, 5,763,270 and 5,693,622, all of which are incorporated herein by reference in their entireties); retroviruses (e.g. see U.S. Pat. No. 5,219,740; Miller and Rosman (1989) BioTechniques 7:980-90; Miller, A. D. (1990) Human Gene Therapy 1:5-14; Scarpa et al. (1991) Virology 180:849-52; Miller et al., Meth. Enzymol. 217:581-599 (1993); Burns et al. (1993) Proc. Natl. Acad. Sci. USA 90:8033-37; Boris-Lawrie and Temin (1993) Curr. Opin. Genet. Develop. 3:102-09. Boesen et al., Biotherapy 6:291-302 (1994); Clowes et al., J. Clin. Invest. 93:644-651 (1994); Kiem et al., Blood 83:1467-1473 (1994); Salmons and Gunzberg, Human Gene Therapy 4:129-141 (1993); and Grossman and Wilson, Curr. Opin. in Genetics and Devel. 3:110-114 (1993), the contents of each of which are herein incorporated by reference in their entireties); lentiviruses (e.g., see U.S. Pat. Nos. 6,143,520; 5,665,557; and 5,981,276, the contents of which are herein incorporated by reference in their entireties; adenovirus-based expression vectors (e.g., see Haj-Ahmad and Graham (1986) J. Virol. 57:267-74; Bett et al. (1993) J. Virol. 67:5911-21; Mittereder et al. (1994) Human Gene Therapy 5:717-29; Seth et al. (1994) J. Virol. 68:933-40; Barr et al. (1994) Gene Therapy 1:51-58; Berkner, K. L. (1988) Bio-Techniques 6:616-29; and Rich et al. (1993) Human Gene Therapy 4:461-76; Wu et al. (2001) Anesthes. 94:1119-32; Parks (2000) Clin. Genet. 58:1-11; Tsai et al. (2000) Curr. Opin. Mol. Ther. 2:515-23; and U.S. Pat. Nos. 6,048,551; 6,306,652 and 6,306,652, incorporated herein by reference in their entireties); Adeno-associated viruses (AAV) (e.g. see U.S. Pat. Nos. 5,139,941; 5,622,856; 5,139,941; 6,001,650; and 6,004,797, the contents of each of which are incorporated by reference herein in their entireties); and avipox vectors (e.g. see WO 91/12882; WO 89/03429; and WO 92/03545; which are incorporated by reference herein in their entireties).

Useful methods of transfection can include, but are not limited to electroporation, sonoporation, protoplast fusion, peptoid delivery, or microinjection. See, e.g., Sambrook et al (1989) Molecular Cloning, A Laboratory Manual, Cold Spring Harbor Laboratories, New York, for a discussion of techniques for transforming cells of interest; and Felgner, P. L. (1990) Advanced Drug Delivery Reviews 5:163-87, for a review of delivery systems useful for gene transfer. Exemplary methods of delivering DNA using electroporation are described in U.S. Pat. Nos. 6,132,419; 6,451,002, 6,418,341, 6,233,483, U.S. Patent Publication No. 2002/0146831, and International Publication No. WO/0045823, all of which are incorporated herein by reference in their entireties.

Non-limiting examples of vectors useful for expression in prokaryotic cells can include plasmids. Plasmid vectors can include, but are not limited to, pBR322, pBR325, pACYC177, pACYC184, pUC8, pUC9, pUC18, pUC19, pLG339, pR290, pKC37, pKC101, SV 40, pBluescript II SK+/− or KS+/− (see "Stratagene Cloning Systems" Catalog (1993) from Stratagene, La Jolla, Calif, which is hereby incorporated by reference), pQE, pIH821, pGEX, pET series (see Studier et. al., "Use of T7 RNA Polymerase to Direct Expression of Cloned Genes," *Gene Expression Technology*, vol. 185 (1990), which is hereby incorporated by reference in its entirety). Non-limiting examples of mammalian and insect appropriate vectors can include pcDNA3, pCMV6, pOptiVec, pFUSE, and pFastBac.

The cell comprising the nucleic acid can be, e.g. a microbial cell or a mammalian cell. In some embodiments, the cell as described herein is cultured under conditions suitable for the expression of the modified integrin α headpiece polypeptides described herein, the modified integrin β headpiece polypeptides described herein, and/or the modified integrin polypeptide dimers described herein. Such conditions can include, but are not limited to, conditions under which the cell is capable of growth and/or polypeptide synthesis. Conditions may vary depending upon the species and strain of cell selected. Conditions for the culture of cells, e.g. prokaryotic and mammalian cells, are well known in the art. In some embodiments, the cell for expressing a modified integrin α headpiece polypeptide described herein, a modified integrin β headpiece polypeptide described herein, and/or a modified integrin polypeptide dimer can be HEK 293 GnTI⁻ cells.

Some Selected Definitions

It should be understood that this invention is not limited to the particular methodology, protocols, and reagents, etc., described herein and as such may vary. The terminology used herein is for the purpose of describing particular embodiments only, and is not intended to limit the scope of the present invention, which is defined solely by the claims.

As used herein and in the claims, the singular forms include the plural reference and vice versa unless the context clearly indicates otherwise. The term "or" is inclusive unless modified, for example, by "either." Other than in the operating examples, or where otherwise indicated, all numbers expressing quantities of ingredients or reaction conditions used herein should be understood as modified in all instances by the term "about." The term "about" with respect to numerical values means within 5%

The term "wild type" refers to the naturally-occurring polypeptide sequence as it normally exists in vivo.

The term "polypeptide" refers to an isolated polymer of amino acid residues, and are not limited to a minimum length unless otherwise defined. Peptides, oligopeptides, dimers, multimers, and the like, are also composed of linearly arranged amino acids linked by peptide bonds, and whether produced biologically and isolated from the natural environment, produced using recombinant technology, or produced synthetically typically using naturally occurring amino acids.

As used herein, the term "modified," when referring to a polypeptide or protein, e.g., the modified integrin α headpiece polypeptides described herein, the modified integrin β headpiece polypeptides described herein, and/or the modified integrin polypeptide dimers described herein, means the polypeptide or protein including at least one or more modifications, such as deletions, additions, and substitutions (generally conservative in nature as would be known to a person in the art), to the native sequence, as long as the protein maintains the desired activity. These modifications can include, e.g., site-directed mutagenesis, and/or mutations of hosts that produce the proteins during recombinant DNA methods.

As used interchangeably herein and throughout the specification, the terms "heterodimer" and "dimer" refer to a polypeptide or protein comprising two or more different subunits. In the context of various aspects described herein, the term "heterodimer" or "dimer" refers to a polypeptide or protein structure comprising, consisting essentially of, or consisting of a wild-type or modified integrin α headpiece polypeptide and a wild-type or modified integrin β headpiece polypeptide. With respect to naturally occurring integrin heterodimer or dimer, a wild-type integrin α headpiece polypeptide and a wild-type integrin β headpiece polypeptide are non-covalently linked to each other. With respect to modified integrin polypeptide dimers described herein, in some embodiments, a modified integrin α headpiece polypeptide and a wild-type integrin β headpiece polypeptide are covalently linked to each other via at least one disulfide bond. In some embodiments, a modified integrin polypeptide dimer can comprise, consist essentially of, or consist of a wild-type integrin α headpiece polypeptide and a modified integrin β headpiece polypeptide covalently linked together via at least one disulfide bond. In some embodiments, a modified integrin polypeptide dimer can comprise, consist essentially of, or consist of a modified integrin α headpiece polypeptide and a modified integrin β headpiece polypeptide covalently linked together via at least one disulfide bond.

The term "substitution" when referring to an amino acid sequence, refers to a change in an amino acid for a different entity, for example another amino acid or amino-acid moiety. Substitutions can be conservative or non-conservative substitutions.

As used herein, the term "test agent" generally refers to a molecule, compound, or composition to be screened in one or more methods described herein (e.g., for binding capability and/or affinity with one or more modified integrin polypeptide dimers described herein). The test agent can be a protein, a peptide, an antibody, a nucleic acid molecule, an aptamer, a peptidomimetic, a small molecule, or any combinations thereof.

The term "antibody" as used herein refers to a full length antibody or immunoglobulin, IgG, IgM, IgA, IgD or IgE molecules, or a protein portion thereof that comprises only a portion of an intact antibody, generally including an antigen binding site of the intact antibody and thus retaining the ability to bind a target, such as an epitope or antigen. Examples of portions of antibodies or epitope-binding proteins encompassed by the present definition include: (i) the Fab fragment, having VL, CL, VH and CH1 domains; (ii) the Fab' fragment, which is a Fab fragment having one or more cysteine residues at the C-terminus of the CH1 domain; (iii) the Fd fragment having VH and CH1 domains; (iv) the Fd' fragment having VH and CH1 domains and one or more cysteine residues at the C terminus of the CH1 domain; (v) the Fv fragment having the VL and VH domains of a single arm of an antibody; (vi) the dAb fragment (Ward et al., 341 Nature 544 (1989)) which consists of a VH domain or a VL domain that binds antigen; (vii) isolated CDR regions or isolated CDR regions presented in a functional framework; (viii) F(ab')2 fragments which are bivalent fragments including two Fab' fragments linked by a disulphide bridge at the hinge region; (ix) single chain antibody molecules (e.g., single chain Fv; scFv) (Bird et al., 242 Science 423 (1988); and Huston et al., 85 PNAS 5879 (1988)); (x) "diabodies" with two antigen binding sites, comprising a heavy chain variable domain (VH) connected to a light chain variable domain (VL) in the same polypeptide chain (see, e.g., EP 404,097; WO 93/11161; Hollinger et al., 90 PNAS 6444 (1993)); (xi) "linear antibodies" comprising a pair of tandem Fd segments (VH-CH1-VH-CH1) which, together with complementary light chain polypeptides, form a pair of antigen binding regions (Zapata et al., 8 Protein Eng. 1057 (1995); and U.S. Pat. No. 5,641,870).

"Antibodies" include antigen-binding portions of antibodies such as epitope- or antigen-binding peptides, paratopes, functional CDRs; recombinant antibodies; chimeric antibodies; tribodies; midibodies; or antigen-binding derivatives, analogs, variants, portions, or fragments thereof.

The term "aptamer" refers to a nucleic acid molecule that is capable of binding to a target molecule, such as a polypeptide. For example, an aptamer of the invention can specifically bind to a target molecule, or to a molecule in a signaling pathway that modulates the expression and/or activity of a target molecule. The generation and therapeutic use of aptamers are well established in the art. See, e.g., U.S. Pat. No. 5,475,096.

As used here in, the term "peptidomimetic" means a peptide-like molecule that has the activity of the peptide on which it is structurally based. Such peptidomimetics include chemically modified peptides, peptide-like molecules containing non-naturally occurring amino acids, and peptoids, and have an activity such as the cardiac specificity of the peptide upon which the peptidomimetic is derived (see, for example, Goodman and Ro, Peptidomimetics for Drug Design, in "Burger's Medicinal Chemistry and Drug Discovery", Vol. 1 (ed. M. E. Wolff; John Wiley & Sons 1995), pages 803-861).

A variety of peptidomimetics are known in the art and can be encompassed within embodiments described herein including, for example, peptide-like molecules which contain a constrained amino acid, a non-peptide component that mimics peptide secondary structure, or an amide bond isostere. A peptidomimetic that contains a constrained, non-naturally occurring amino acid can include, for example, an α-methylated amino acid; α,α-dialkylglycine or α-aminocycloalkane carboxylic acid; an Nα-Cacyclized amino acid; an Nα-methylated amino acid; αβ- or γ-amino cycloalkane carboxylic acid; an α,β-unsaturated amino acid; a β,β-dimethyl or β-methyl amino acid; αβ-substituted-2,3-methano amino acid; an N-Cδ or Cα-Cδcyclized amino acid; a substituted proline or another amino acid mimetic. A peptidomimetic which mimics peptide secondary structure can contain, for example, a nonpeptidic β-turn mimic; γ-turn mimic; mimic of β-sheet structure; or mimic of helical structure, each of which is well known in the art. A peptidomimetic also can be a peptide-like molecule which contains, for example, an amide bond isostere such as a retro-inverso modification; reduced amide bond; methylenethioether or methylene-sulfoxide bond; methylene ether bond; ethylene bond; thioamide bond; transolefin or fluoroolefin bond; 1,5-disubstituted tetrazole ring; ketomethylene or fluoroketomethylene bond or another amide isostere. One skilled in the art understands that these and other peptidomimetics are encompassed within the meaning of the term "peptidomimetic" as used herein.

Methods for identifying a peptidomimetic are well known in the art and include, for example, the screening of databases that contain libraries of potential peptidomimetics. For example, the Cambridge Structural Database contains a collection of greater than 300,000 compounds that have known crystal structures (Allen et al., Acta Crystallogr. Section B, 35:2331 (1979)). This structural depository is continually updated as new crystal structures are determined and can be screened for compounds having suitable shapes, for example, the same shape as a peptide described herein, as well as potential geometrical and chemical complementarity to a cognate receptor. Where no crystal structure of a peptide described herein is available, a structure can be generated using, for example, the program CONCORD (Rusinko et al., J. Chem. Inf. Comput. Sci. 29:251 (1989)).

Another database, the Available Chemicals Directory (Molecular Design Limited, Informations Systems; San Leandro Calif.), contains about 100,000 compounds that are commercially available and also can be searched to identify potential peptidomimetics of a peptide described herein, for example, having specificity for the microbes.

Embodiments of various aspects described herein can be defined in any of the following numbered paragraphs:

1. A modified integrin $\alpha_v$ headpiece polypeptide comprising an amino acid sequence of SEQ ID NO: 1 with at least one Cys residue introduced thereto by one or more of the following modifications (a)-(e):
   a. substitution of amino acid residues 399-401 (Ser-Met-Pro) with one of the following: (i) Ser-Cys-Pro; (ii) Gly-Cys-Pro; (iii) Ser-Cys-Gly; (iv) Gly-Cys-Gly; (v) Ser-Gly-Cys-Pro (SEQ ID NO: 59); (vi) Ser-Cys-Gly-Pro (SEQ ID NO: 60); (vii) Gly-Cys-Gly-Pro (SEQ ID NO: 61); and (viii) Ser-Gly-Cys-Gly (SEQ ID NO: 62);
   b. substitution of amino acid residues 310-311 (Gln-Glu) with Gly-Cys;
   c. substitution of amino acid residues 299 (Leu) and 310 (Gln) with Cys and Gly, respectively;
   d. substitution of amino acid residues 302-311 (Asp-Arg-Gly-Ser-Asp-Gly-Lys-Leu-Gln-Glu) (SEQ ID NO: 63) with Gly-Gln-Gly-Cys (SEQ ID NO: 64); and/or
   e. substitution of amino acid residue 299 (Leu) to Cys and substitution of amino acid residues 302-310 (Asp-Arg-Gly-Ser-Asp-Gly-Lys-Leu-Gln) (SEQ ID NO: 65) with Gly-Gln-Gly.

2. The modified integrin $\alpha_v$ headpiece polypeptide of paragraph 1, wherein the modified integrin $\alpha_v$ headpiece polypeptide is a soluble polypeptide.

3. A modified integrin $\beta_6$ headpiece polypeptide comprising a $\beta$I domain of integrin $\beta_6$ subunit with at least one Cys residue introduced thereto by one or more of the following modifications (f)-(h), the $\beta$I domain is defined from residues DYP to residues ELR as shown in an amino acid sequence of SEQ ID NO: 2:
   f. substitution of amino acid residue 270 (Ile) with Cys;
   g. substitution of amino acid residue 294 (Thr) with Cys; and
   h. substitution of amino acid residue 296 (Gly) with Cys.

4. The modified integrin $\beta_6$ headpiece polypeptide of paragraph 3, further comprising a PSI domain of integrin $\beta_6$, wherein the PSI domain is defined from residues HVQ to residues NFI as shown in an amino acid sequence of SEQ ID NO: 2.

5. The modified integrin $\beta_6$ headpiece polypeptide of paragraph 3 or 4, further comprising a hybrid domain of integrin $\beta_6$, wherein the hybrid domain is defined from residues ENP to residues QTE, and/or from residues SEV to residues ECN as shown in an amino acid sequence of SEQ ID NO: 2.

6. The modified integrin $\beta_6$ headpiece polypeptide of any of paragraphs 3-5, further comprising a EGF-1 domain of integrin $\beta_6$, wherein the EGF-1 domain is defined from residues CDC to residues SRG as shown in an amino acid sequence of SEQ ID NO: 2.

7. The modified integrin $\beta_6$ headpiece polypeptide of paragraph 3, which comprises an amino acid sequence of SEQ ID NO: 2 with said at least one Cys residue introduced thereto by one or more the modifications (f)-(h).

8. The modified integrin $\beta_6$ headpiece polypeptide of any of paragraphs 3-7, wherein the modified integrin $\beta_6$ headpiece polypeptide is a soluble polypeptide.

9. A modified integrin $\beta_3$ headpiece polypeptide comprising amino acid residues 27 to 498 of SEQ ID NO: 5 with at least one Cys residue introduced thereto by substitution of amino acid residue 293 (Gln) with Cys.

10. The modified integrin $\beta_3$ headpiece polypeptide of paragraph 9, wherein the modified integrin $\beta_3$ headpiece polypeptide is a soluble polypeptide.

11. A modified integrin $\beta_8$ headpiece polypeptide comprising amino acid residues 43 to 498 of SEQ ID NO: 6 with at least one Cys residue introduced thereto by substitution of amino acid residue 301 (Val) with Cys.

12. The modified integrin $\beta_8$ headpiece polypeptide of paragraph 11, wherein the modified integrin $\beta_8$ headpiece polypeptide is a soluble polypeptide.

13. A modified integrin polypeptide dimer comprising the modified integrin $\alpha_v$ headpiece polypeptide of paragraph 1 or 2 and at least one domain of an integrin $\beta$ polypeptide selected from the group consisting of a PSI domain, hybrid domain, $\beta$I domain, and an EGF-1 domain, wherein the modified integrin $\alpha_v$ headpiece polypeptide and said at least one domain of the integrin $\beta$ polypeptide are covalently linked by at least one disulfide bond.

14. The modified integrin polypeptide dimer of paragraph 13, wherein the modified integrin $\alpha_v$ headpiece polypeptide comprises substitution of amino acid residues 399-401 (Ser-Met-Pro) with one of the following: (a) Ser-Cys-Pro; (b) Gly-Cys-Pro; and (c) Ser-Gly-Cys-Pro (SEQ ID NO: 59).

15. The modified integrin polypeptide dimer of paragraph 13 or 14, wherein the integrin $\beta$ polypeptide is selected from the group consisting of $\beta_1$, $\beta_2$, $\beta_3$, $\beta_4$, $\beta_5$, $\beta_6$, $\beta_7$, and $\beta_8$.

16. A modified integrin polypeptide dimer comprising an integrin $\alpha$ polypeptide and the modified integrin $\beta_6$ headpiece polypeptide of any of paragraphs 3-8, wherein the integrin $\alpha$ polypeptide and the modified integrin $\beta_6$ headpiece polypeptide are covalently linked by at least one disulfide bond.

17. The modified integrin polypeptide dimer of paragraph 16, wherein the modified integrin $\beta_6$ headpiece polypeptide comprises substitution of amino acid residue 270 (Ile) with Cys.

18. A modified integrin polypeptide dimer comprising an integrin $\alpha$ polypeptide and the modified integrin $\beta_3$ headpiece polypeptide of any of paragraphs 9-10, wherein the integrin ca polypeptide and the modified integrin $\beta_3$ headpiece polypeptide are covalently linked by at least one disulfide bond.

19. A modified integrin polypeptide dimer comprising an integrin $\alpha$ polypeptide and the modified integrin $\beta_8$ headpiece polypeptide of any of paragraphs 11-12, wherein the integrin $\alpha$ polypeptide and the modified integrin $\beta_8$ headpiece polypeptide are covalently linked by at least one disulfide bond.

20. The modified integrin polypeptide dimer of any of paragraphs 16-19, wherein the integrin $\alpha$ polypeptide is selected from the group consisting of $\alpha_1$, $\alpha_2$, $\alpha_3$, $\alpha_4$, $\alpha_5$, $\alpha_6$, $\alpha_7$, $\alpha_8$, $\alpha_9$, $\alpha_{10}$, $\alpha_{11}$, $\alpha_D$, $\alpha_E$, $\alpha_L$, $\alpha_M$, $\alpha_v$, $\alpha_{2B}$, and $\alpha_X$.

21. The modified integrin polypeptide dimer of paragraph 20, wherein the integrin $\alpha$ polypeptide is an integrin $\alpha_v$ polypeptide.

22. A modified integrin polypeptide dimer comprising the modified integrin $\alpha_v$ headpiece polypeptide of paragraph 1 or 2 and the modified integrin $\beta_6$ headpiece polypeptide of any of paragraphs 3-8, wherein the modified integrin $\alpha_v$ headpiece polypeptide and the integrin $\beta_6$ headpiece polypeptide are covalently linked by at least one disulfide bond.

23. The modified integrin polypeptide dimer of paragraph 22, wherein the modified integrin $\alpha_v$ headpiece polypeptide comprises substitution of amino acid residues 399-401 (Ser-Met-Pro) with one of the following: (i) Ser-Cys-Pro; (ii) Gly-Cys-Pro; and (iii) Ser-Gly-Cys-Pro (SEQ ID NO: 59).

24. The modified integrin polypeptide dimer of paragraph 22 or 23, wherein the modified integrin $\beta_6$ headpiece polypeptide comprises substitution of amino acid residue 270 (Ile) with Cys.

25. A modified integrin polypeptide dimer comprising the modified integrin $\alpha_v$ headpiece polypeptide of paragraph 1 or 2 and the modified integrin $\beta_3$ headpiece polypeptide of any of paragraphs 9-10, wherein the modified integrin $\alpha_v$ headpiece polypeptide and the integrin $\beta_3$ headpiece polypeptide are covalently linked by at least one disulfide bond.

26. The modified integrin polypeptide dimer of paragraph 25, wherein the modified integrin $\alpha_v$ headpiece polypeptide comprises substitution of amino acid residues 399-401 (Ser-Met-Pro) with (iii) Ser-Gly-Cys-Pro (SEQ ID NO: 59).

27. A modified integrin polypeptide dimer comprising the modified integrin $\alpha_v$ headpiece polypeptide of paragraph 1 or 2 and the modified integrin $\beta_8$ headpiece polypeptide of any of paragraphs 11-12, wherein the modified integrin $\alpha_v$ headpiece polypeptide and the integrin $\beta_8$ headpiece polypeptide are covalently linked by at least one disulfide bond.

28. The modified integrin polypeptide dimer of paragraph 27, wherein the modified integrin $\alpha_v$ headpiece polypeptide comprises substitution of amino acid residues 399-401 (Ser-Met-Pro) with (iii) Ser-Gly-Cys-Pro (SEQ ID NO: 59).

29. A method for determining whether a test agent forms a complex with an integrin, the method comprising contacting the modified integrin polypeptide dimer of any of paragraphs 13-28 with the test agent, and detecting formation of a complex comprising the modified integrin polypeptide dimer and the test agent bound thereto, whereby detection of a complex indicates that the test agent is capable of forming a complex with the integrin.

30. The method of paragraph 29, wherein the detecting comprises crystallization of the complex.

31. The method of paragraph 29 or 30, further comprising, prior to the detecting, contacting the modified integrin polypeptide dimer with a competing agent, wherein the competing agent is capable of competing with the test agent to bind the modified integrin polypeptide dimer.

32. The method of paragraph 31, wherein the competing agent is a competing peptide.

33. The method of paragraph 32, wherein the competing peptide comprises an amino acid sequence of $X_3$-Arg-Gly-Asp-Leu-$X_1$-$X_2$-Leu/Ile (SEQ ID NO: 79), wherein $X_1$, $X_2$, and $X_3$ are each independently an amino acid molecule.

34. The method of paragraph 33, wherein the $X_1$ and/or $X_3$ is a Gly molecule.

35. The method of paragraph 33 or 34, wherein the $X_2$ is an Arg molecule.

36. The method of any of paragraphs 29-35, wherein the competing agent comprises a detectable label.

37. The method of paragraphs 29 or 30, wherein the test agent comprises a detectable label.

38. The method of paragraph 36 or 37, wherein the detectable label comprises biotin, a fluorescent dye or molecule, a luminescent or bioluminescent marker, a radiolabel, an enzyme, a quantum dot, an imaging agent, or any combination thereof.

39. The method of paragraph 38, wherein the detectable label comprises a fluorescent molecule.

40. The method of paragraph 39, wherein the detecting is performed by fluorescence anisotropy and/or flow cytometry.

41. A method for determining binding affinity of a test agent to an integrin, the method comprising (i) contacting the modified integrin polypeptide dimer of any of paragraphs 13-28 with the test agent and a competing agent, wherein the competing agent comprises a detectable label and is capable of competing with the test agent to bind the modified integrin polypeptide dimer; and (ii) detecting a signal from the detectable label of the competing agent that forms a complex with the integrin, whereby a decrease in the detected signal relative to a signal corresponding to saturation binding of the competing agent to the modified integrin polypeptide dimer indicates that the test agent has a higher binding affinity than the competing agent to the integrin.

42. The method of paragraph 41, wherein the competing agent is a competing peptide.

43. The method of paragraph 42, wherein the competing peptide comprises an amino acid sequence of $X_3$-Arg-Gly-Asp-Leu-$X_1$-$X_2$-Leu (SEQ ID NO: 66), wherein $X_1$, $X_2$, and $X_3$ are each independently an amino acid molecule.

44. The method of paragraph 43, wherein the $X_1$ and/or $X_3$ is a Gly molecule.

45. The method of paragraph 43 or 44, wherein the $X_2$ is an Arg molecule.

46. The method of any of paragraphs 41-45, wherein the detecting comprises crystallization of the complex.

47. The method of any of paragraphs 41-46, wherein the detectable label comprises biotin, a fluorescent dye or molecule, a luminescent or bioluminescent marker, a radiolabel, an enzyme, a quantum dot, an imaging agent, or any combination thereof.

48. The method of paragraph 47, wherein the detectable label comprises a fluorescent molecule.

49. The method of paragraph 48, wherein the detecting is performed by fluorescence anisotropy and/or flow cytometry.

50. The method of any of paragraphs 41-49, wherein the concentrations of the test agent and the competing agent are essentially the same.

51. A method of identifying an anti-$\alpha_v\beta_6$ inhibitor comprising:
(a) generating on a computer a molecular representation of a pharmacophore comprising a basic functional group, an acidic functional group for coordination of a metal ion to a metal ion-dependent adhesion site (MIDAS) in integrin β6 subunit, a first hydrophobic functional group, and a second hydrophobic functional group, wherein the functional groups are arranged to satisfy the following conditions:
the distance between the first hydrophobic functional group (H1) and the second hydrophobic functional group (H2) is about 7-8 Å; the distance between the second hydrophobic functional group (H2) and the basic functional group (B) is about 8-9 Å; the distance between the basic functional group (B) and the acidic functional group (A) is about 15-16 Å; the distance between the first hydrophobic functional group (H1) and the acidic functional group (A) is about 14.5-15.5 Å; and the distance between the second hydrophobic functional group (H2) and the acidic functional group (A) is about 19-20 Å; and the angle formed by H1-A-B is about 20°-24°; the angle formed by H1-A-H2 is about 17°-21°; the angle formed by H2-A-B is about 26°-30°; the angle formed by A-B-H1 is about 68°-72°; the angle formed by A-B-H2 is about 96°-100°; and the angle formed by H1-B-H2 is about 49°-53°;

(b) generating on a computer atomic coordinates of an $\alpha_v\beta_6$ integrin protein or a portion thereof having at least a hydrophobic binding pocket in $\beta_6$ subunit; and (c) determining on a computer likelihood of the molecular representation interacting with one or more residues of the computer-generated $\alpha_v\beta_6$ integrin protein or a portion thereof, thereby identifying a candidate anti-$\alpha_v\beta_6$ inhibitor.

52. The method of paragraph 37, wherein the first and second hydrophobic functional groups are each independently selected from an aromatic ring (aryl) or a linear moiety.

53. A method of identifying an anti-$\alpha_v\beta_6$ inhibitor comprising:

(a) providing, on a computer, a three-dimensional crystalline structure of $\alpha_v\beta_6$ integrin protein or a portion thereof characterized by atomic structure coordinates (e.g., as described in Table 6 of PCT Application No: PCT/US15/44093 filed Aug. 6, 2015), or a three-dimensional structure that exhibits a root-mean-square difference (rmsd) in $\alpha$-carbon positions of less than 2.0 Å (or less than 1.0 Å) with the atomic structure coordinates (e.g., described in Table 6 PCT Application No: PCT/US15/44093 filed Aug. 6, 2015);

(b) docking on the computer a first molecular entity in a first part of a binding pocket of the integrin i$\beta_6$ headpiece polypeptide having an amino acid sequence of SEQ ID NO: 2, to determine the binding association between the first molecular entity and the first part of the binding pocket, wherein the binding pocket comprises amino acid residues Ala-217, Asn-218, Pro-179, Cys-180, Ile-183, Ala-126, and Tyr-185;

(c) docking on the computer a second molecular entity in a second part of the binding pocket, to determine the binding association between the second molecular entity and the second part of the binding pocket;

(d) repeating steps (b) to (c) with a different first and second molecular entity;

(e) selecting a first and a second chemical entity based on the quantified binding associations; and (f) generating on the computer a pharmacophore model by assembling the selected first and second molecular entity into a molecular representation that interacts with the binding pocket.

54. The method of any of paragraphs 37-39, further comprising contacting the candidate anti-$\alpha_v\beta_6$ inhibitor (based on the pharmacophore model) with an $\alpha_v\beta_6$ integrin protein to determine the ability of the candidate anti-$\alpha_v\beta_6$ integrin inhibitor to bind the $\alpha_v\beta_6$ integrin protein.

55. A crystalline composition comprising a ligand-binding headpiece of integrin $\alpha_v\beta_6$, wherein the crystalline composition is characterized with space group C2, and has unit cell parameters a=184.5±3 Å, b=168.3±3 Å, c=101.8±3 Å, α=β=90°, and γ=98.2°+3°.

56. A crystalline composition comprising a ligand-binding headpiece of integrin $\alpha_v\beta_6$ and a ligand, wherein the crystalline composition is characterized with space group C2, and has unit cell parameters a=184.4±3 Å, b=170.0±3 Å, c=102.4±3 Å, α=β=90°, and γ=98.7°±3°.

57. The crystalline composition of paragraph 41 or 42, wherein the ligand-binding headpiece of integrin $\alpha_v\beta_6$ comprises a modified integrin $\alpha_v$ headpiece polypeptide of paragraph 1, and a modified integrin $\beta_6$ headpiece polypeptide of paragraph 3.

58. The crystalline composition of paragraph 43, wherein the crystalline composition has a binding pocket in the modified integrin $\beta_6$ headpiece polypeptide, wherein the binding pocket comprises amino acid residues Ala-217, Asn-218, Pro-179, Cys-180, Ile-183, Ala-126, and Tyr-185.

59. The crystalline composition of any of paragraphs 41-44, wherein the ligand-binding headpiece of integrin $\alpha_v\beta_6$ is described by the atomic structure coordinates (e.g., described in Table 6 of PCT Application No: PCT/US15/44093 filed Aug. 6, 2015), or a structure that exhibits a root-mean-square difference (rmsd) in $\alpha$-carbon positions of less than 2.0 Å (or less than 1.0 Å) with the atomic structure coordinates (e.g., described in Table 6 of PCT Application No: PCT/US15/44093 filed Aug. 6, 2015).

60. The crystalline composition of any of paragraphs 41-45, wherein the crystal composition is formed from a crystallization solution buffered between pH 6-8 at a temperature of about 20° C. and having an ionic strength of about 800-900 mM.

61. A method of identifying an anti-$\alpha_v\beta_3$ inhibitor comprising:

(a) providing, on a computer, a three-dimensional crystalline structure of $\alpha_v\beta_3$ integrin protein or a portion thereof characterized by atomic structure coordinates (e.g., as described in Table 8 of PCT Application No: PCT/US15/44093 filed Aug. 6, 2015), or a three-dimensional structure that exhibits a root-mean-square difference (rmsd) in $\alpha$-carbon positions of less than 2.5 Å (or less than 2.0 Å, or less than 1.0 Å) with the atomic structure coordinates (e.g., as described in Table 8 of PCT Application No: PCT/US15/44093 filed Aug. 6, 2015);

(b) docking on the computer a first molecular entity in a first part of a binding pocket of the integrin $\beta_3$ headpiece polypeptide having an amino acid sequence of SEQ ID NO: 5 or a fragment thereof, to determine the binding association between the first molecular entity and the first part of the binding pocket;

(c) docking on the computer a second molecular entity in a second part of the binding pocket, to determine the binding association between the second molecular entity and the second part of the binding pocket;

(d) repeating steps (b) to (c) with a different first and second molecular entity;

(e) selecting a first and a second chemical entity based on the quantified binding associations; and (f) generating on the computer a pharmacophore model by assembling the selected first and second molecular entity into a molecular representation that interacts with the binding pocket.

62. The method of paragraph 61, further comprising contacting the candidate anti-$\alpha_v\beta_3$ inhibitor (based on the pharmacophore model) with an $\alpha_v\beta_3$ integrin protein to determine the ability of the candidate anti-$\alpha_v\beta_3$ integrin inhibitor to bind the $\alpha_v\beta_3$ integrin protein.

63. A crystalline composition comprising a ligand-binding headpiece of integrin $\alpha_v\beta_3$, wherein the crystalline composition is characterized with space group P22$_1$2$_1$, and has unit cell parameters a=87±2 Å, b=124±2 Å, c=165±2 Å, α=β=90°, and γ=90°±30°

64. The crystalline composition of paragraph 63, wherein the ligand-binding headpiece of integrin $\alpha_v\beta_3$ comprises a modified integrin $\alpha_v$ headpiece polypeptide of paragraph 1, and a modified integrin $\beta_3$ headpiece polypeptide of paragraph 9.

65. The crystalline composition of any of paragraphs 63-64, wherein the ligand-binding headpiece of integrin $\alpha\alpha_v\beta_3$ is described by the atomic structure coordinates (e.g., as described in Table 8 of PCT Application No: PCT/US15/44093 filed Aug. 6, 2015), or a structure that exhibits a root-mean-square difference (rmsd) in α-carbon positions of less than 2.5 Å (or less than 2.0 Å, or less than 1.0 Å) with the atomic structure coordinates (e.g, described in Table 8 of PCT Application No: PCT/US15/44093 filed Aug. 6, 2015).

66. The crystalline composition of any of paragraphs 63-65, wherein the crystal composition is formed from a crystallization solution buffered between pH 6-8 at a temperature of about 20° C. and having an ionic strength of about 800-900 mM.

67. A crystalline composition comprising a ligand-binding headpiece of integrin $\alpha_v\beta_8$, wherein the crystalline composition is characterized with space group P1, and has unit cell parameters a=153±3 Å, b=55±3 Å, c=181±3 Å, α=β=90°, and γ=110°±3°.

68. The crystalline composition of paragraph 67, wherein the ligand-binding headpiece of integrin $\alpha_v\beta_8$ comprises a modified integrin $\alpha_v$ headpiece polypeptide of paragraph 1, and a modified integrin $\beta_8$ headpiece polypeptide of paragraph 11.

69. The crystalline composition of any of paragraphs 67-68, wherein the crystal composition is formed from a crystallization solution buffered between pH 6-8 at a temperature of about 20° C. and having an ionic strength of about 800-900 mM.

70. A method of identifying an anti-$\alpha_v\beta_8$ inhibitor comprising:
   (a) providing, on a computer, a three-dimensional crystalline structure of $\alpha_v\beta_8$ integrin protein or a portion thereof derived from the crystalline composition of any of paragraphs 67-69;
   (b) docking on the computer a first molecular entity in a first part of a binding pocket of the integrin $\beta_8$ headpiece polypeptide having an amino acid sequence of SEQ ID NO: 6 or a fragment thereof, to determine the binding association between the first molecular entity and the first part of the binding pocket;
   (c) docking on the computer a second molecular entity in a second part of the binding pocket, to determine the binding association between the second molecular entity and the second part of the binding pocket;
   (d) repeating steps (b) to (c) with a different first and second molecular entity;
   (e) selecting a first and a second chemical entity based on the quantified binding associations; and
   (f) generating on the computer a pharmacophore model by assembling the selected first and second molecular entity into a molecular representation that interacts with the binding pocket.

71. The method of paragraph 70, further comprising contacting the candidate anti-$\alpha_v\beta_8$ inhibitor (based on the pharmacophore model) with an $\alpha_v\beta_8$ integrin protein to determine the ability of the candidate anti-$\alpha_v\beta_8$ integrin inhibitor to bind the $\alpha_v\beta_8$ integrin protein.

72. A modified integrin $\alpha_v$ headpiece polypeptide comprising, essentially consisting of, or consisting of an amino acid sequence of SEQ ID NO: 131.

73. A modified integrin $\beta_6$ headpiece polypeptide comprising an amino acid sequence of SEQ ID NO: 133 (with or without a $His_6$ tag (SEQ ID NO: 132)) or SEQ ID NO: 135.

74. A modified integrin $\beta_3$ headpiece polypeptide comprising, essentially consisting of, or consisting of an amino acid sequence of SEQ ID NO: 136.

75. A modified integrin $\beta_8$ headpiece polypeptide comprising, essentially consisting of, or consisting of an amino acid sequence of SEQ ID NO: 134 or SEQ ID NO: 137.

76. A modified integrin polypeptide dimer comprising, essentially consisting of, or consisting of (i) the modified integrin $\alpha_v$ headpiece polypeptide of paragraph 72, and (ii) the modified integrin $\beta_6$ headpiece polypeptide of paragraph 73.

77. A modified integrin polypeptide dimer comprising, essentially consisting of, or consisting of (i) the modified integrin $\alpha_v$ headpiece polypeptide of paragraph 72, and (ii) the modified integrin $\beta$ headpiece polypeptide of paragraph 74.

78. A modified integrin polypeptide dimer comprising, essentially consisting of, or consisting of (i) the modified integrin $\alpha_v$ headpiece polypeptide of paragraph 72, and (ii) the modified integrin $\beta_8$ headpiece polypeptide of paragraph 75.

As used herein, the term "comprising" or "comprise(s)" is used in reference to compositions, methods, and respective component(s) thereof, that are essential to the invention, yet open to the inclusion of unspecified elements, whether essential or not.

As used herein, the term "consisting essentially of" or "consist(s) essentially of" or "essentially consisting of," or "essentially consist(s) of" refers to those elements required for a given embodiment. The term permits the presence of additional elements that do not materially affect the basic and novel or functional characteristic(s) of that embodiment of the invention.

As used herein, the term "consisting of" or "consist(s) of" refers to compositions, methods, and respective components thereof as described herein, which are exclusive of any element not recited in that description of the embodiment.

All patents and other publications identified are expressly incorporated herein by reference for the purpose of describing and disclosing, for example, the methodologies described in such publications that might be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

Unless defined otherwise, all technical and scientific terms used herein have the same meaning as those commonly understood to one of ordinary skill in the art to which this invention pertains. Although any known methods, devices, and materials may be used in the practice or testing of the invention, the methods, devices, and materials in this regard are described herein.

EXAMPLES

The following examples illustrate some embodiments and aspects of the invention. It will be apparent to those skilled in the relevant art that various modifications, additions, substitutions, and the like can be performed without altering the spirit or scope of the invention, and such modifications and variations are encompassed within the scope of the invention as defined in the claims which follow. The following examples do not in any way limit the invention.

Example 1. Example Methods of Expression, Affinity Measurement, and Inhibitor Pharmacophore Model of Integrin $\alpha_v/\beta_6$ As integrins are non-covalently linked heterodimers of $\alpha$ and $\beta$ subunits, to prevent $\alpha/\beta$ dissociation, a disulfide bond was introduced to covalently link the subunits together. A series of cysteine combinations was designed to form the disulfides, based on the crystal structure of integrin $\alpha_v\beta_6$. Residues in the $\alpha_v$ $\beta$-propeller domain and $\beta_6$ $\beta$I-domain, which are distal from the ligand-binding site, were evaluated. Twelve $\alpha_v$ mutants and three $\beta_6$ mutants chosen are listed below:

On $\alpha_v$, residues S399-M400-P401 (SMP) are mutated as follows, including some mutations that insert an extra residue: $\alpha_v$s1. SCP, $\alpha_v\beta_6$ s2. GCP, $\alpha_v$s3. SCG, $\alpha_v$s4. GCG, $\alpha_v$s5. SGCP (SEQ ID NO: 59), $\alpha_v$s6. SCGP (SEQ ID NO: 60), $\alpha_v$s7. GCGP (SEQ ID NO: 61), $\alpha_v$s8. SGCG (SEQ ID NO: 62).

Other mutations in $\alpha_v$ are:
$\alpha_v$s9. Q310 and E311 to G310 and C311 (Q310G and E311C)
$\alpha_v$s10. L299 and Q310 to C299 and G310 (L299C and Q310G)
$\alpha_v$s11. 302DRGSDGKLQE311 (SEQ ID NO: 63) to GQGC (SEQ ID NO: 64) (this involves deletion of a loop)
$\alpha_v$s12. L299 to C299 (L299C) plus 302DRGSDGKLQ310 (SEQ ID NO: 65) to GQG On P6, the mutations are:
$\beta_6$s1. I270 to C270 (I270C)
$\beta_6$s2. T294 to C294 (T294C)
$\beta_6$s3. G296 to C296 (G296C)

Expression tests of the mutant combinations were performed in 293s GnTI⁻ cells. Two days after transient transfection, supernatants were subjected to western blot using anti-his antibody. Results showed that $\alpha_v$s1, $\alpha_v$s2, or $\alpha_v$s5 with $\beta_6$s11 could be highly expressed under the experiment settings, among which, the combination of $\alpha_v$s5/$\beta_6$s1 showed the highest expression level.

It was next sought to determine whether a disulfide bridge can be introduced to other integrin heterodimers. $\alpha_5\beta_1$, $\alpha_v\beta_3$, $\alpha_v\beta_8$, $\alpha_4\beta_1$ and $\alpha_4\beta_7$. Results showed that $\alpha_5\beta_1$, $\alpha_v\beta_3$, and $\alpha_v\beta_3$ can form the disulfide bond, whereas $\alpha_4\beta_1$ and $\alpha_7\beta_7$ cannot.

Example 2. Binding Affinity Measurements by Fluorescence Anisotropy

A fluorescence probe for integrin $\alpha_v\beta_6$, the sequence of which is FITC-GRGDLGRL (SEQ ID NO: 68), was synthesized. Saturation binding affinity measurements showed the probe binds to $\alpha_v\beta_6$ at 100 nM and 10 nM under physiological buffer containing 1 mM $Mg^{2+}/Ca^{2+}$ or $Mn^{2+}/Ca^{2+}$, respectively. By competition binding assay, the affinities of Different Ligands were Measured.

Example 3. Pharmacophore Model for Anti-$\alpha_v\beta_6$ Inhibitor

According to the crystal structure of $\alpha_v\beta_6$ in complex with TGF-$\beta$3 peptide (e.g., as described in Example, a pharmacophore model for an anti-$\alpha_v\beta_6$ inhibitor was built. The pharmacophore comprises three features, a basic functional group, an acidic functional group for coordination of the metal ion to the MIDAS in $\beta_6$, and two hydrophobic functional groups.

Example 4. Example Use of the Modified Integrin Polypeptide Dimers Described Herein—to Identify Structural Determinants of Integrin $\beta$-Subunit Specificity for Latent TGF-$\beta$ Eight integrin $\alpha/\beta$ heterodimers including five with the $\alpha_v$ subunit recognize ligands with an Arg-Gly-Asp (RGD) motif. However, the structural mechanism by which integrins differentiate among the many extracellular proteins with RGD motifs and achieve specificity is not understood. In this example, how $\alpha_v\beta_6$ and $\alpha_v\beta_8$, which are uniquely important in the activation of TGF-$\beta$ in vivo, achieve specificity was investigated. As presented herein, TGF-$\beta$ activation by $\alpha_v\beta_6$ and $\alpha_v\beta_8$ is related to unusually high affinity. Crystal structures show the determinants of the high affinity of $\alpha_v\beta_6$ for a pro-TGF-$\beta$ undecapeptide and mutations extend the results to activation of pro-TGF-$\beta$1. Both an RGD motif and a following LXXL/I motif that folds into an amphipathic $\alpha$-helix when bound to the integrin $\beta$-subunit are required for high affinity. Structural elucidation of the basis for ligand-binding specificity by the integrin $\beta$-subunit indicates contributions by three different $\beta$I domain loops, which we propose to designate specificity-determining loop (SDL)-1, 2, and 3. Variation in a pair of single key residues in SDL-1 and 3 correlates with the variation of the entire $\beta$ subunit in integrin evolution.

Pro-TGF-$\beta$1 Activation by Integrin Correlates with High Affinity

Transfectants expressing $\alpha_v\beta_6$ and $\alpha_v\beta_8$, but not $\alpha_v$ co-transfected with the $\beta_1$, $\beta_3$ and $\beta_5$ subunits, can activate pro-TGF-$\beta$ (FIG. 1A). Correlating with activation, $\alpha_v\beta_6$ and $\alpha_v\beta_8$, but not other $\alpha_v$ integrin transfectants, strongly bound 50 nM FITC-pro-TGF-$\beta_1$. (FIG. 1B).

Ligands bind to the integrin headpiece, which contains the $\alpha$-subunit $\beta$-propeller domain and thigh domain, and the $\beta$-subunit $\beta$I, hybrid, PSI, and EGF1 domain. Using competition with the pro-TGF-$\beta$3 peptide FITC-GRGDLGRL (SEQ ID NO: 68), peptide affinity for the $\alpha_v\beta_6$ and $\alpha_v\beta_3$ headpiece was measured with fluorescence anisotropy. Nonapeptides containing RGD from pro-TGF-$\beta$1 and pro-TGF-$\beta$3 bound to $\alpha_v\beta_6$ with remarkably high affinity of 10.3 nM and 8.5 nM (FIG. 1C). In contrast, the same peptides bound to $\alpha_v\beta_3$ with 1,000-fold lower affinity (FIG. 1D). Interestingly, the homologous peptide from pro-TGF-$\beta$2, which has SGDQ (SEQ ID NO: 70) in place of RGDL (SEQ ID NO: 71) of pro-TGF-$\beta$1, also bound to $\alpha_v\beta_6$, but with 1,000-fold lower affinity (8.5 μM), and was comparable in affinity to the GRGDSP (SEQ ID NO: 72) peptide of fibronectin (2.5 μM) (FIG. 1C).

Example $\alpha_v\beta_6$ Crystal Structures $\alpha_v\beta_6$ crystal structures (e.g., one or more embodiments of the modified integrin polypeptide dimers described herein) were used to determine the basis for the high affinity of $\alpha_v\beta_6$ for pro-TGF-$\beta$ and its peptides. Crystals of the $\alpha_v\beta_6$ headpiece, with or without a pro-TGF-$\beta$3 undecapeptide soaked therein, diffracted to 2.5 and 2.85 Å respectively, and contain two molecules per asymmetric unit with almost identical structures. Table 4 below shows statistics of X-ray diffraction and structure refinement.

| | $\alpha_v\beta_6$ | $\alpha_v\beta_{6+}$ TGF-β3 peptide |
|---|---|---|
| Data collection statistics | | |
| Space group | C2 | C2 |
| α, β, γ ° | 90, 90, 98.2 | 90, 90, 98.7 |
| Unit cell (a, b, c) Å | 184.5, 168.3, 101.8 | 184.4, 170.0, 102.4 |
| Resolution range (Å) | 50.0-2.85 (2.92-2.85)[a] | 50.0-2.50 (2.67-2.50) |
| Completeness (%) | 97.4 (91.0) | 94.4 (70.6) |
| Number unique reflections | 69,928 (4,837) | 87,425 (5,641) |
| Redundancy | 2.4 (2.3) | 2.3 (2.1) |
| $R_{merge}$ (%)[b] | 17.5 (349) | 11.6 (233) |
| I/σ(I) | 4.8 (0.33) | 4.9 (0.35) |
| $CC_{1/2}$ (%)[c] | 98.2 (10.4) | 98.3 (10.4) |
| Wavelength (Å) | 1.0332 | 1.0332 |
| Refinement statistics | | |
| $R_{work}$ (%)[d] | 23.6 (38.0) | 22.2 (39.9) |
| $R_{free}$ (%) | 27.9 (41.7) | 26.6 (44.4) |
| Bond RMSD (Å) | 0.005 | 0.009 |
| Angle RMSD (°) | 0.76 | 1.2 |
| Ramachandran plot[e] (Favored/allowed/outlier) | 95.7/4.1/0.2 | 95.8/4.0/0.2 |
| Number of waters | 161 | 207 |
| PDB | 4UM8 | 4UM9 |

[a] The numbers in parentheses refer to the highest resolution shell.
[b] Rmerge = Σh Σi|Ii(h) − <I(h)>|/ΣhΣiIi(h), where Ii(h) and <I(h)> are the ith and mean measurement of the intensity of reflection h.
[c] Pearson's correlation coefficient between average intensities of random half-datasets for each unique reflection (25).
[d] Rfactor = Σh||Fobs(h)| − |Fcalc (h)||/Σh|Fobs (h)|, where Fobs (h) and F calc (h) are the observed and calculated structure factors, respectively. No I/σ(I) cutoff was applied.
[e] Calculated with MolProbity (28).

The headpiece adopts the closed headpiece conformation in the absence of ligand (FIG. 2A), i.e. with the hybrid domain swung in toward the α-subunit and with the β1-α1, and β6-α7 loops and α7-helix in the βI domain in the closed conformation (8, 12-14). Compared to $\beta_3$, the $\beta_6$ βI and PSI domains are similar in structure, with greater differences in the hybrid domain (Table 5).

TABLE 5

Cα Root-Mean-Square Deviation (RMSD) to $\alpha_v\beta_6$ headpiece-TGF-β peptide complex (RMSD was calculated using the align command of PyMol with zero refinement cycles.)

| Domain | Unliganded $\alpha_v\beta_6$ (Å) | $\alpha_v\beta_3$ (3G1E) (Å) | $\alpha_{IIb}\beta_3$ (2FCS) (Å) |
|---|---|---|---|
| β-propeller | 0.3 | 0.5 | 2.8 |
| Thigh | 0.4 | 0.9 | 2.6 |
| βI | 0.6 | 0.9 | 0.9 |
| Hybrid | 0.6 | 1.5 | 1.8 |
| PSI | 0.5 | 0.8 | 0.9 |
| EGF1 | NA | 3.2 | 3.2 |

Figure 2A:
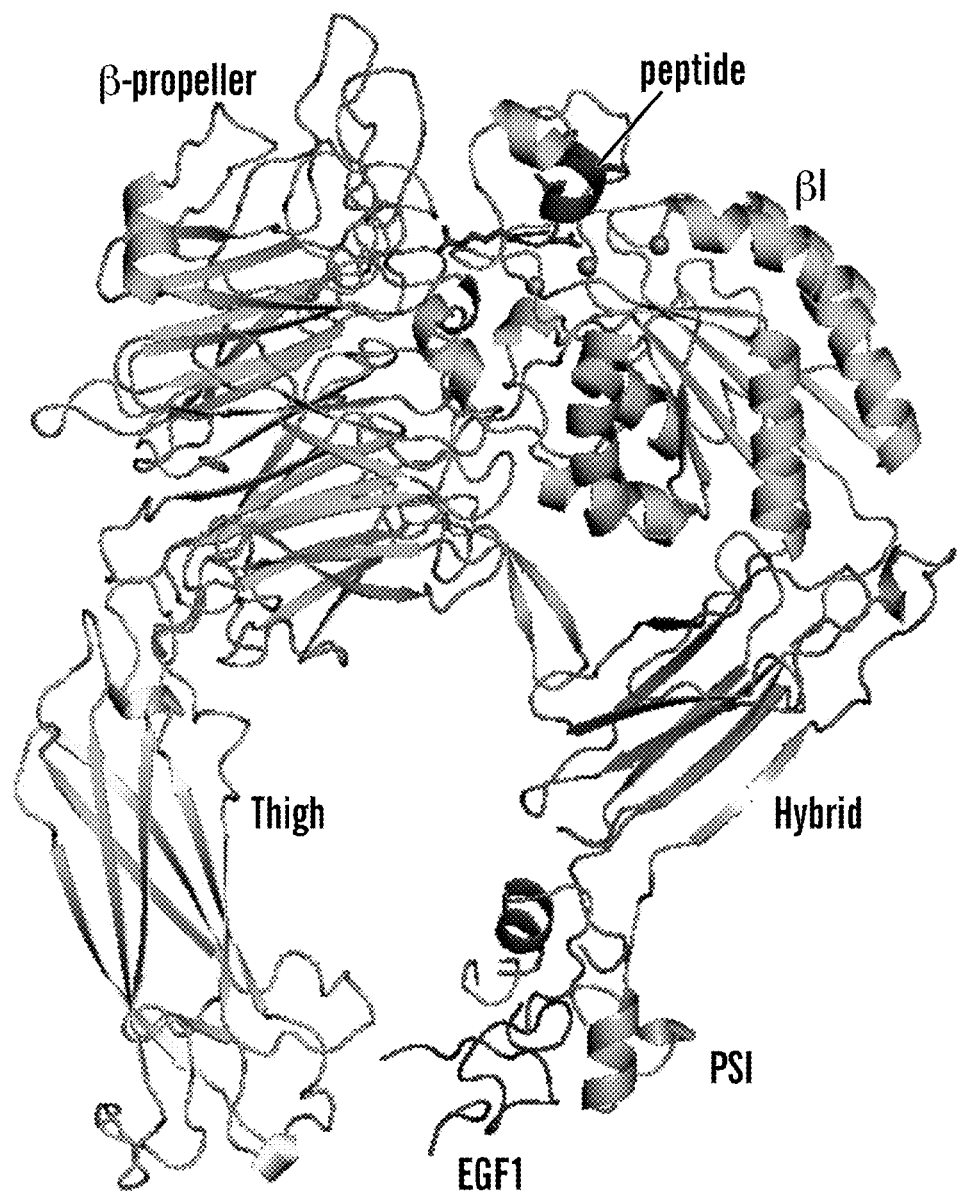
FIGS. 2A-2H show crystal structures and comparisons of $\alpha_v\beta_6$ headpiece.
Figure 2B:
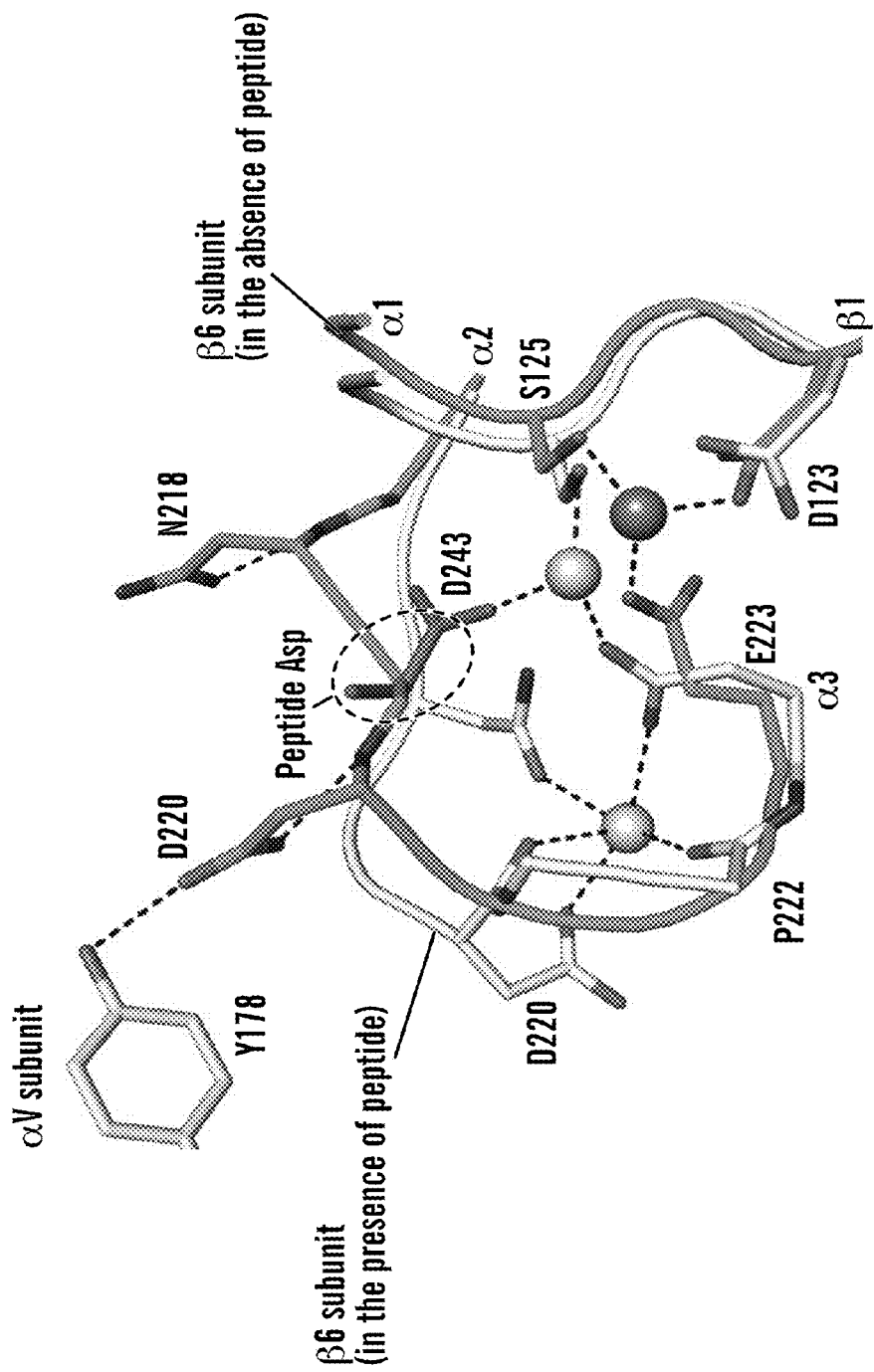
Figure 2C:
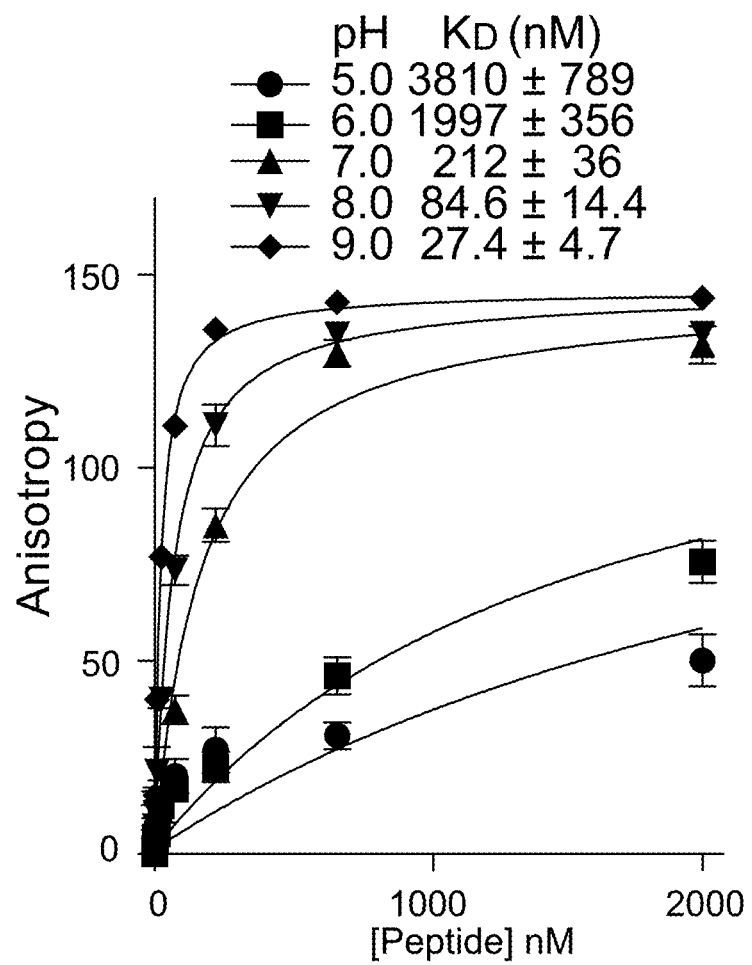

Three closely spaced metal ion binding sites are present in the integrin βI domain, the synergistic metal ion binding site (SyMBS), metal ion dependent adhesion site (MIDAS), and adjacent to MIDAS (ADMIDAS). $\alpha_v\beta_6$ crystallized at pH 6.5 loses its SyMBS metal ion; furthermore, the SyMBS-coordinating α2-α3 loop also remodels and invades the ligand-binding pocket (FIG. 2B). Remodeling enables SyMBS residues Asn-218 and Asp-220 to point outward and form three strong, 2.4 to 2.7 Å hydrogen bonds in place of $Ca^{2+}$-coordination (FIG. 2B). Similar remodeling of the $\beta_3$-subunit α2-α3 loop in the absence of a SyMBS $Ca^{2+}$ is blocked by the large sidechains that characterize its ligand binding pocket, especially $\beta_3$ Arg-214 and Tyr-166 in place of $\beta_6$ Ala-217 and Lys-170 (FIG. 2F-2H).

The inventors hypothesized that crystallization at pH 4.5-6.5 might be responsible for variable loss of SyMBS, MIDAS, and/or ADMIDAS metal ions from $\alpha_v\beta_3$ (12, 14) and $\alpha_v\beta_6$, in contrast to occupation of all three sites in $\alpha_{IIb}\beta_3$ crystallized at higher pH (13, 15). To evaluate this hypothesis, the effect of pH on affinity of $\alpha_v\beta_6$ for the TGF-β3 nonapeptide was examined. Fluorescence anisotropy demonstrated strong pH dependence with a sharp decrease in affinity between pH 7 and 6 (FIG. 2C). As many cells co-express integrins with their ligands, including epithelial cells that coexpress $\alpha_v\beta_6$ and pro-TGF-β1, without wishing to be bound by theory, this pH-dependence may contribute to the inhibition of ligand binding during biosynthesis in the Golgi (pH 6.0-6.7) and transport in endosomes (pH 6.3-6.5) (16).

Ligand binding by $\alpha_v\beta_6$

Figure 2D:
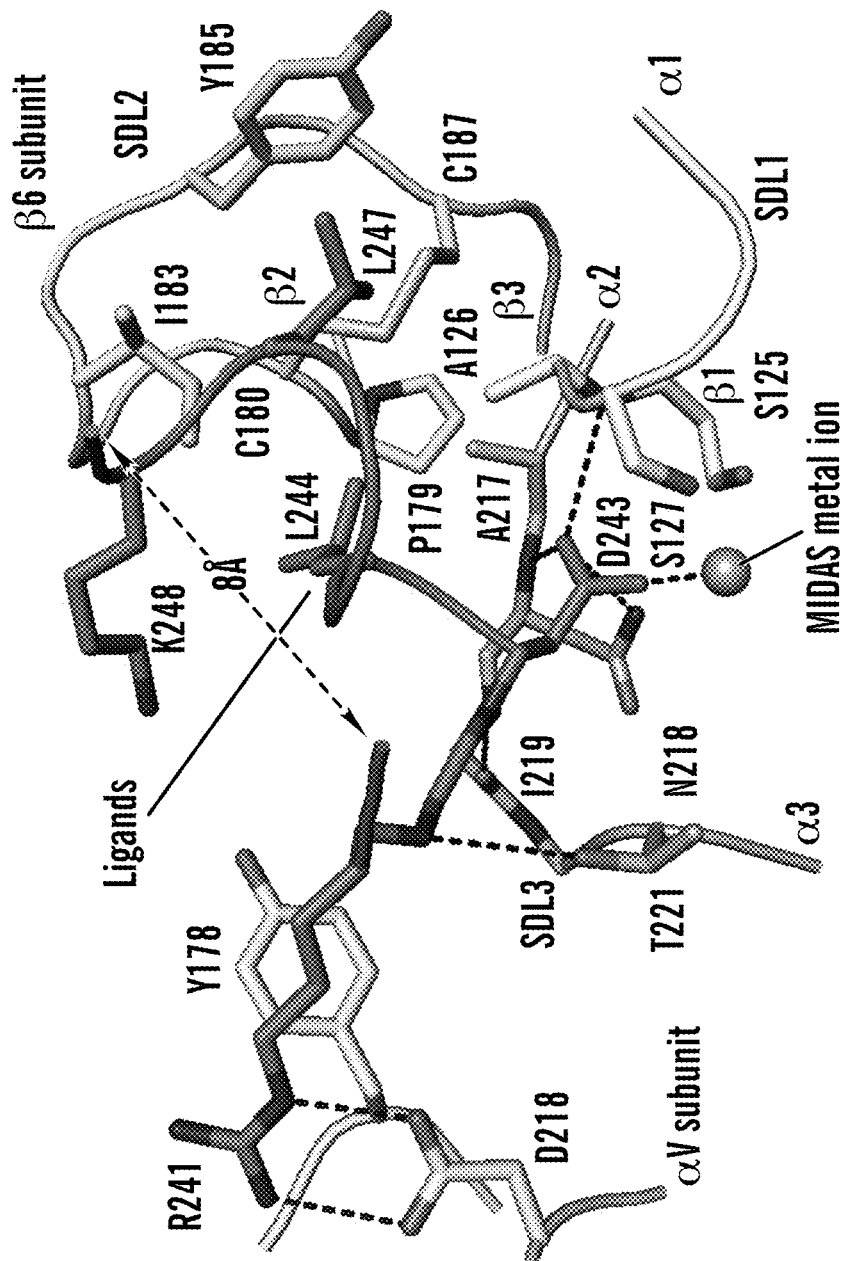
Figure 2E:
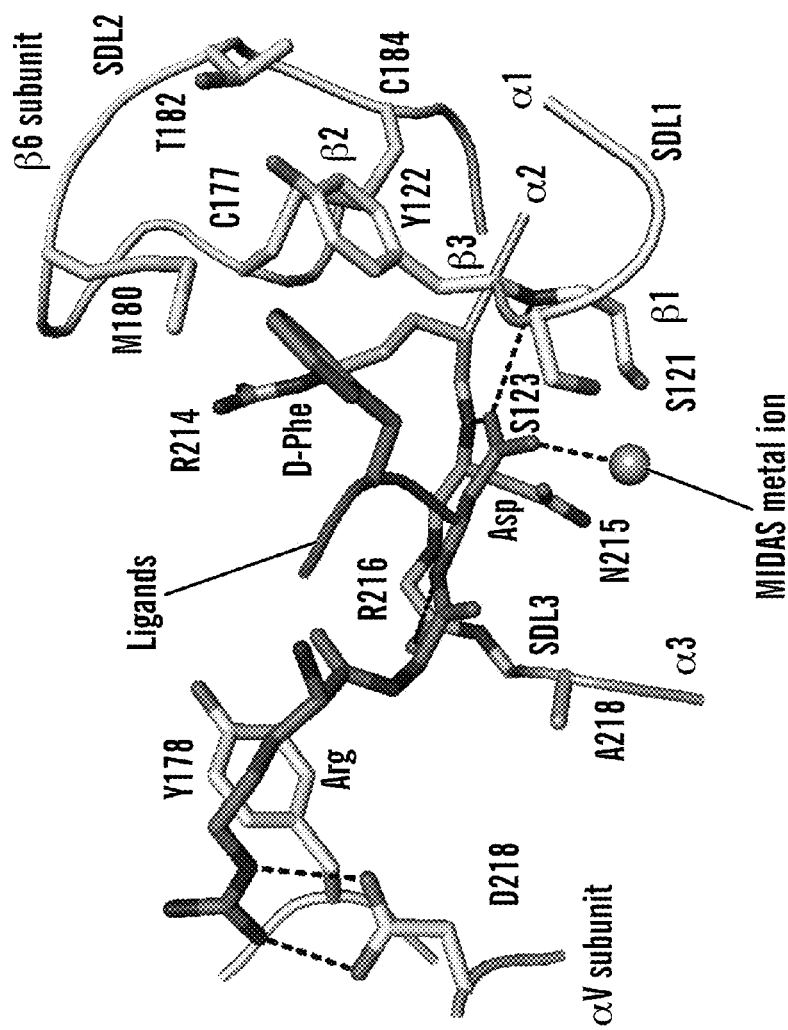
Figure 2F:
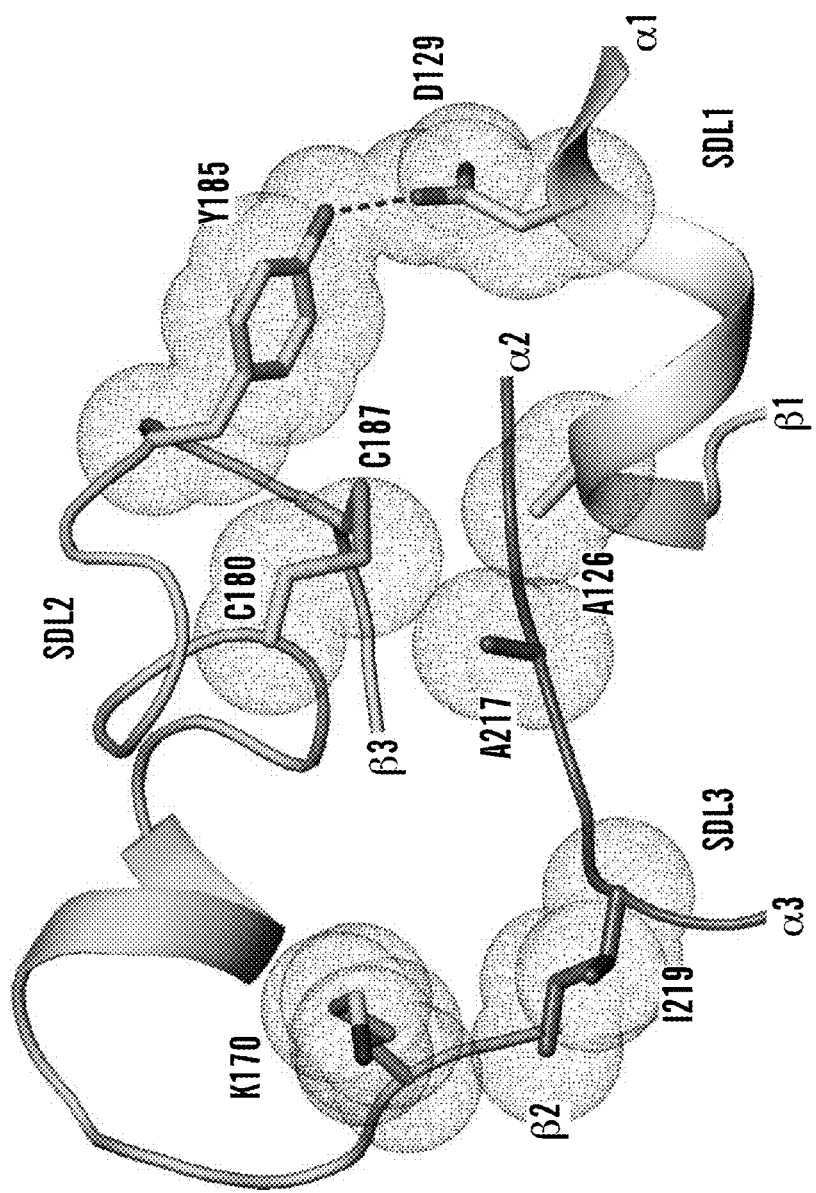
Figure 2G:
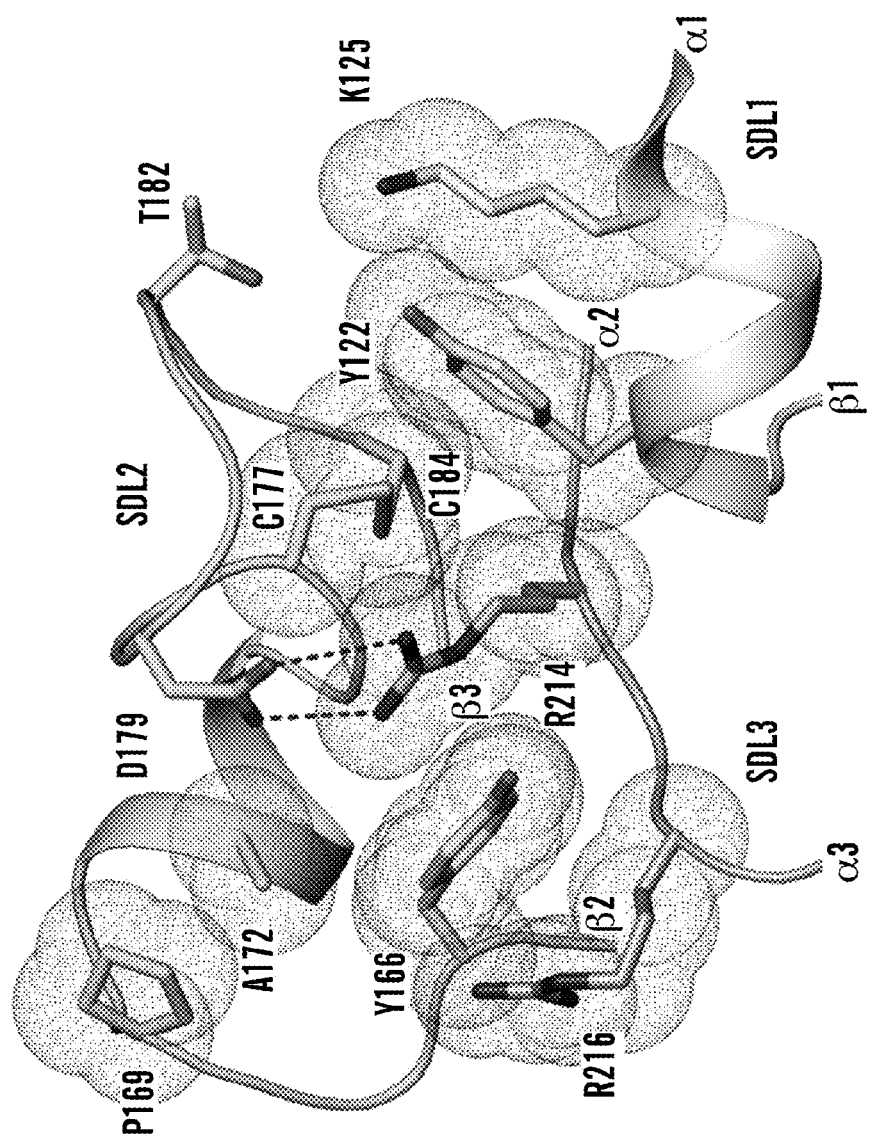
Figure 2H:
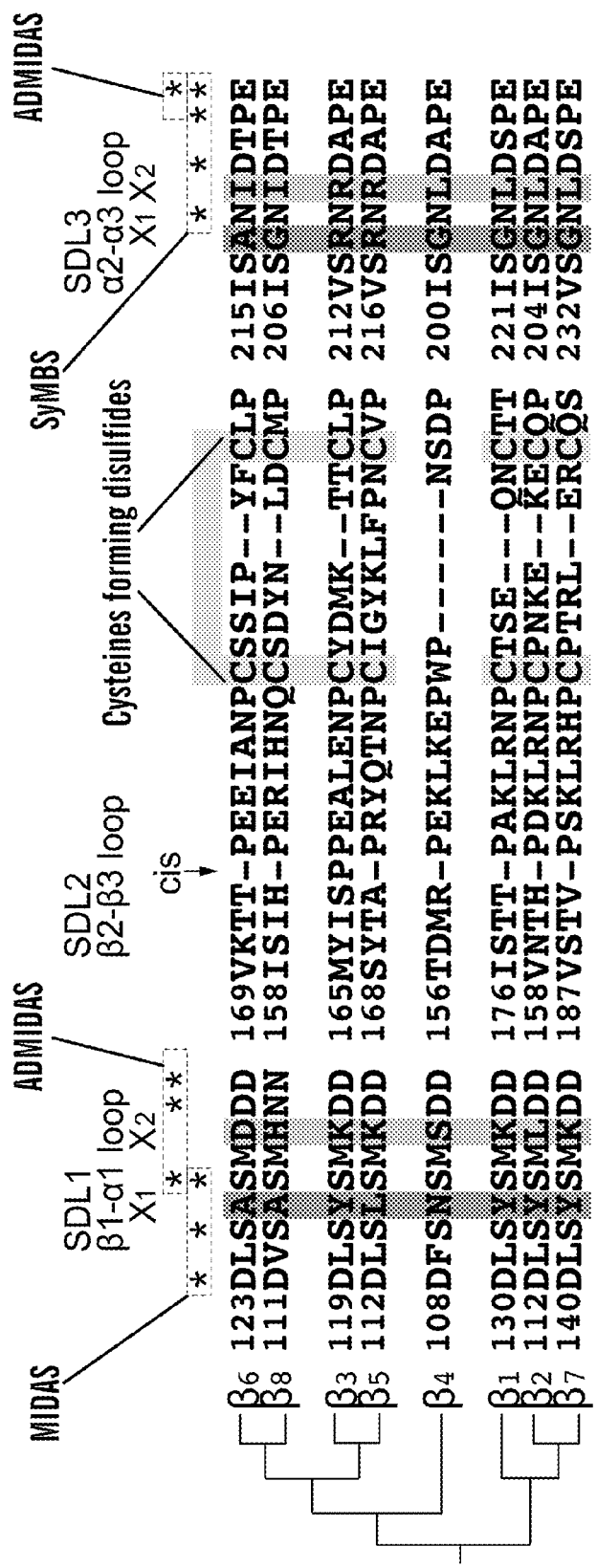

Soaking ligand into $\alpha_v\beta_6$ crystals restored a $Ca^{2+}$-bound conformation of the SyMBS α2-α3 loop (FIG. 2B) and showed how TGF-β3 peptide binds with high affinity (FIG. 2D). Ligand binding induced a local ~1.5 Å displacement of the β1-α1 loop toward the Asp of RGD and the MIDAS $Mg^{2+}$ (FIG. 2B), as seen in intermediate states of other integrins with RGD soaked in (9, 12, 15). The Asp of RGD coordinated the MIDAS $Mg^{2+}$ ion through one sidechain oxygen and formed hydrogen bonds to NH groups of Asn-218 and Ala-126 through the other sidechain oxygen (FIG. 2D). The Arg of RGD formed bidentate hydrogen bonds through its guanido group to the sidechain of Asp-218 in the $\alpha_v$ β-propeller domain (FIG. 2D), as in binding to $\alpha_v\beta_3$ (FIG. 2E) (7). Furthermore, as the ligand spanned the $\alpha_v$-$\beta_6$ interface, the backbone of the RGD Arg formed a hydrogen bond to the sidechain of Thr-221 in the $\beta_6$ α2-α3 loop (FIG. 2D). A similar hydrogen bond to the ligand backbone can form with $\beta_8$, but not with $\beta_3$ or $\beta_5$, which have Ala in the position of $\beta_6$ Thr-221 (FIG. 2E and FIG. 2H).

The largest conformational difference in the ligand-binding region between $\alpha_v\beta_6$ and $\alpha_v\beta_3$ is in the β2-β3 loop. This loop is displaced in $\beta_6$ relative to $\beta_3$ both as a consequence of sequence differences in the β2-β3 loop itself, and in the β1-α1 and α2-α3 loops with which it interacts (FIGS. 2F-2H). The path of the β2-β3 loop is altered in β3 by the insertion of cis-Pro-169 (FIG. 2G and FIG. 2H) as well as π-cation bonds between β2-β3 residue Tyr-166 and α2-α3 residues Arg-214 and Arg-216 (FIG. 2G). The three residues forming it-cation bonds are replaced in $\beta_6$ by Lys-170, Ala-217 and Ile-219 (FIG. 2F). Furthermore, a hydrogen bond between Tyr-185 in the β2-β3 loop and Asp-129 in the β1-α1 loop constrains the conformation at the C-terminal portion of the β2-β3 loop in $\beta_6$ (FIG. 2F). Thus, backbone differences in the β2-β3 loop derive not only from the difference in its own sequence, but also from differences in sequences of loops that interact with the β2-β3 loop.

Strikingly, the TGF-β3 peptide forms an α-helix which extensively interfaces with the $\beta_6$-subunit (FIG. 2A and FIG. 2D). Immediately following the Asp of RGD, the sequence $L^{244}GRL^{247}K$ (SEQ ID NO: 73) forms an amphipathic α-helix. TGF-β Leu-244 binds in a $\beta_6$-subunit hydrophobic pocket formed by the sidechain of Ala-217 and backbone of Asn-218 in the α2-α3 loop, the backbone of Pro-179 and sidechains of Cys-180 and Ile-183 in the β2-β3 loop, and sidechain of Ala-126 in the β1-α1 loop (FIG. 2D). The aliphatic portion of the ligand Lys-248 sidechain contributes to burying Leu-244. Ligand residue Leu-247 further buries Leu-244, and binds in the same hydrophobic pocket by interacting with the backbone and sidechain of Ala-126 in the β1-α1 loop; and with the sidechain of Ile-183, the disulfide bond of Cys-177 and Cys-184, and the aromatic ring of Tyr-185 in the β2-β3 loop. Thus, three different loops in the βI domain make contacts with TGF-β ligand (FIG. 2D).

Figure 1B:
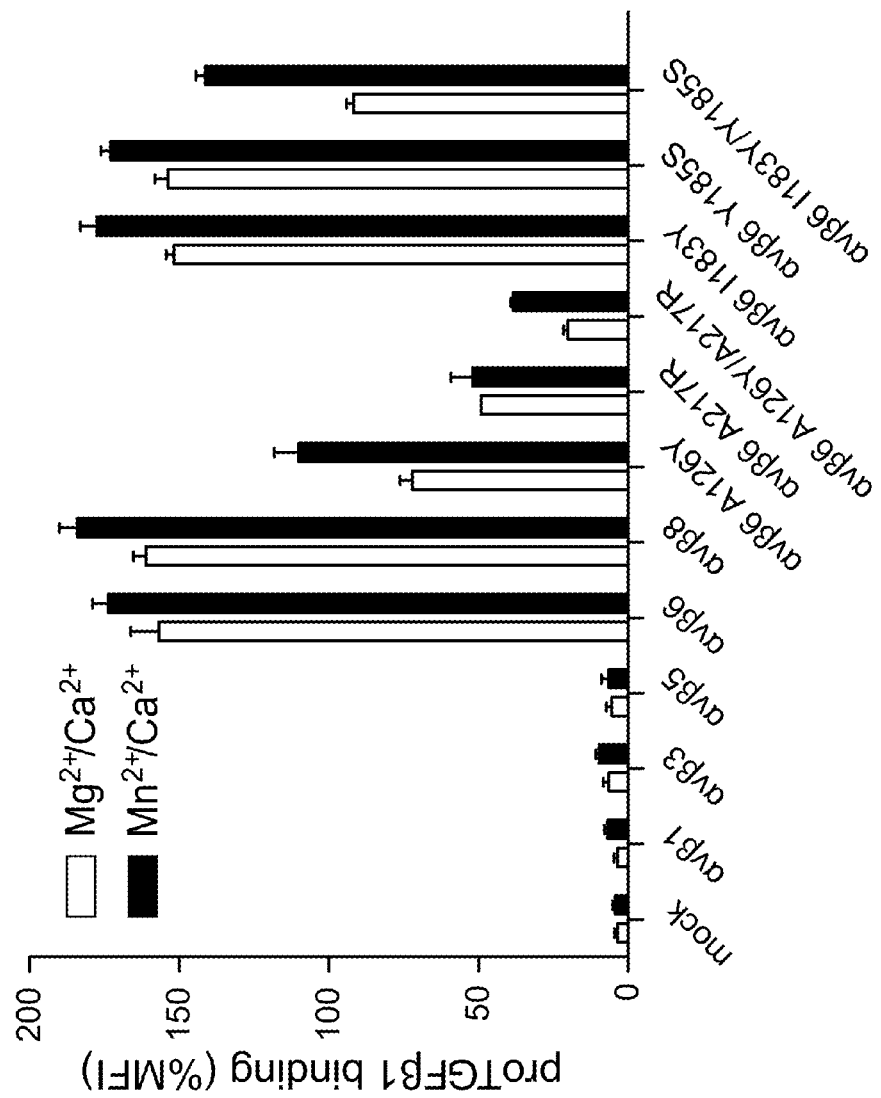
Figure 1C:
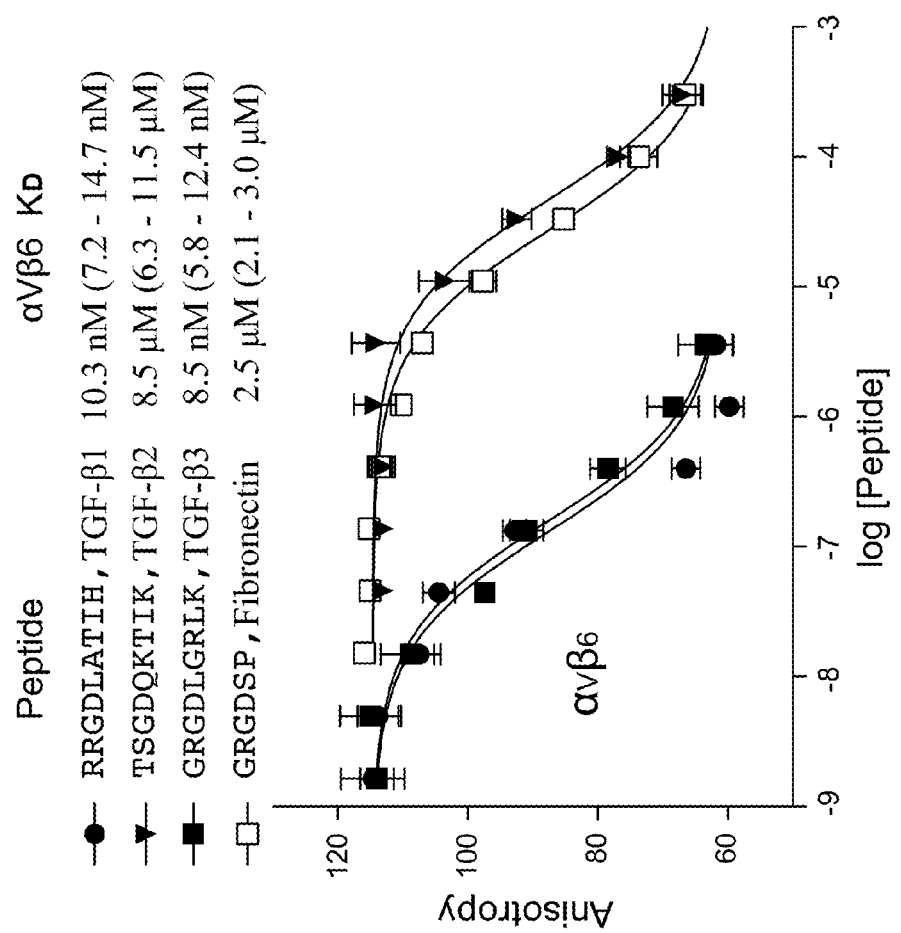
Figure 1D:
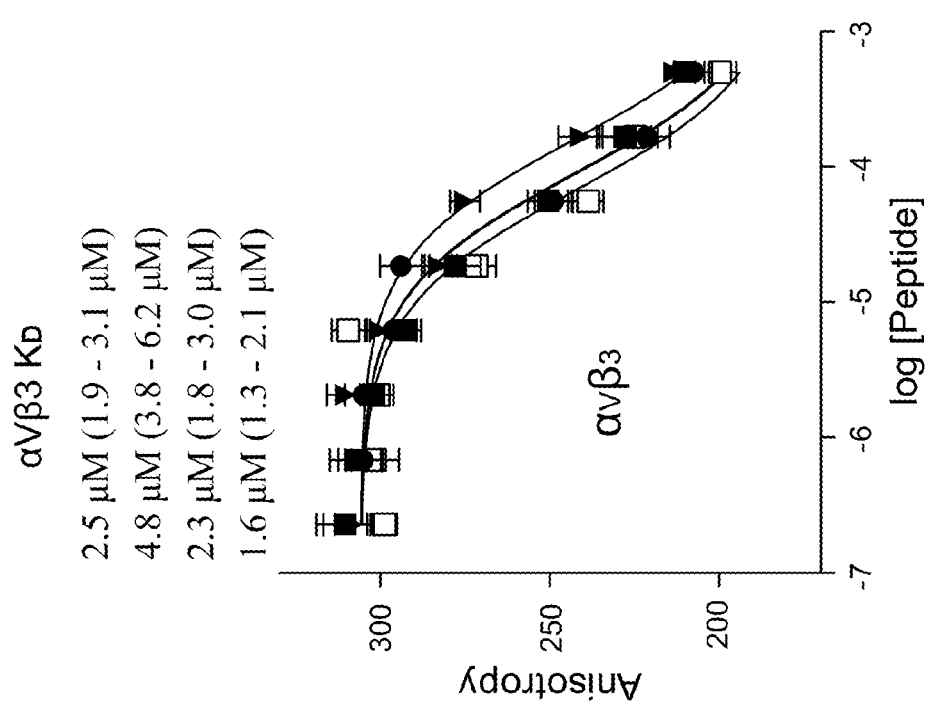

Integrin β-subunits vary markedly at the positions in the β1-α1 and α2-α3 loops where Ala-126 and Ala-217 contact the amphipathic TGF-β α-helix (FIG. 2H). Ala-126, in the β$_6$ DLSA$^{126}$S (SEQ ID NO: 74) MIDAS motif, is conserved as Ala in β$_8$, but is a Tyr in 133 (Tyr-122, FIG. 2G) and in the β$_1$, β$_2$, and β$_7$ subunits (FIG. 2H). Introduction of the Tyr residue with the A126Y mutation significantly decreased both binding of pro-TGF-β1 and activation of TGF-β1 (FIG. 1A and FIG. 1B). Ala-217 in the α2-α3 loop is a small residue (Gly or Ala) in most integrin β-subunits, but a large Arg in the β$_3$ and β$_5$ subunits (FIG. 2H). The A217R and double A126Y/A217R mutations completely abolished pro-TGF-β1 binding and activation (FIG. 1A and FIG. 1B).

Between the two disulfide-bonded cysteines in the β2-β3 loop, where I183 and Y185 contact the pro-TGF-β α-helix, integrins are highly diverse (6) (FIG. 2H). However, individual β$_6$ I183Y and Y185S mutations had no effect, and the double mutation only slightly affected α$_v$β$_6$ binding and activation of pro-TGF-β1 (FIG. 1A and FIG. 1B).

The Integrin-Binding Loop in Pro-TGF-β

In the ligand, the Gly residue preceding RGD extends back towards the amphipathic α-helix (FIG. 2D). Thus, Gly-240 and Lys-248 in G$^{240}$RGDLGRLK$^{248}$ (SEQ ID NO: 75) are only 8 Å apart (FIG. 2D). The sequence in between has an overall loop-like conformation, with Asp-243 and Leu-244 most buried in the binding pocket, which is centered on the β$_6$ subunit rather than the α$_v$β$_6$ interface (FIG. 2D). Because the two ends of the pro-TGF-β3 peptide are near one another and orient away from the integrin, the peptide complex is highly compatible with integrin binding to a pro-TGF-β3 macromolecule.

Figures 3A, 3B:
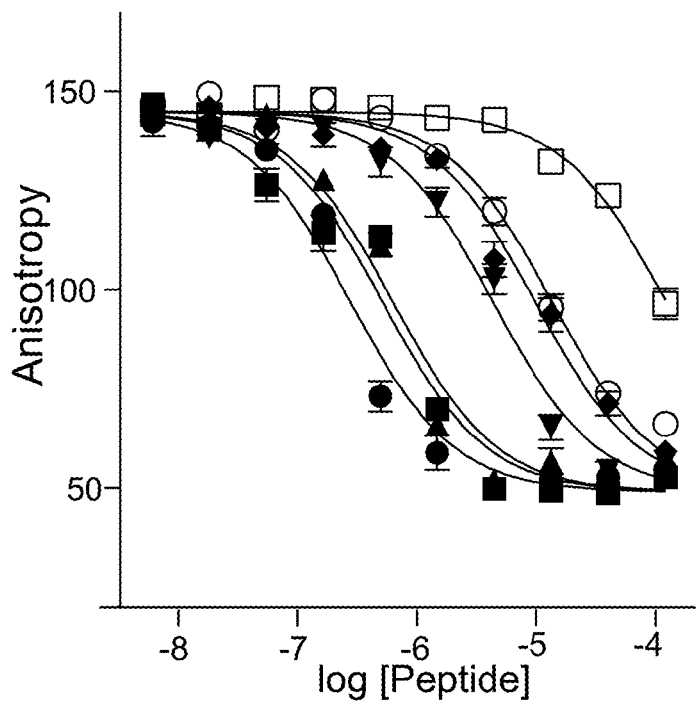
FIGS. 3A-3D show experimental data on ligands of $\alpha_v\beta6$.

The integrin-binding residues identified in this Example lie near the middle of an 18-residue segment that is disordered or only weakly ordered in the structure of pro-TGF-β1(17), and can easily protrude from the shoulder region of pro-TGF-β to bind α$_v$β$_6$ in the helical conformation identified in this Example. Interestingly, FIG. 3A shows that foot-and-mouth disease virus (FMDV) utilizes an RGD motif followed by an amphipathic sequence very similar to those in pro-TGF-β1 and β3 (18) to bind integrin α$_v$β$_6$ and infect epithelial cells.

Figure 3C:
Figure 3D:
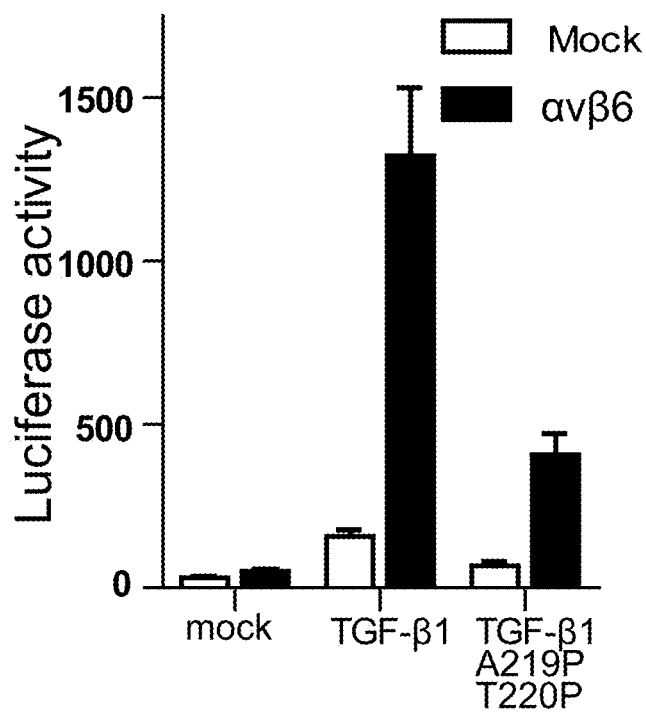
Figure 4:
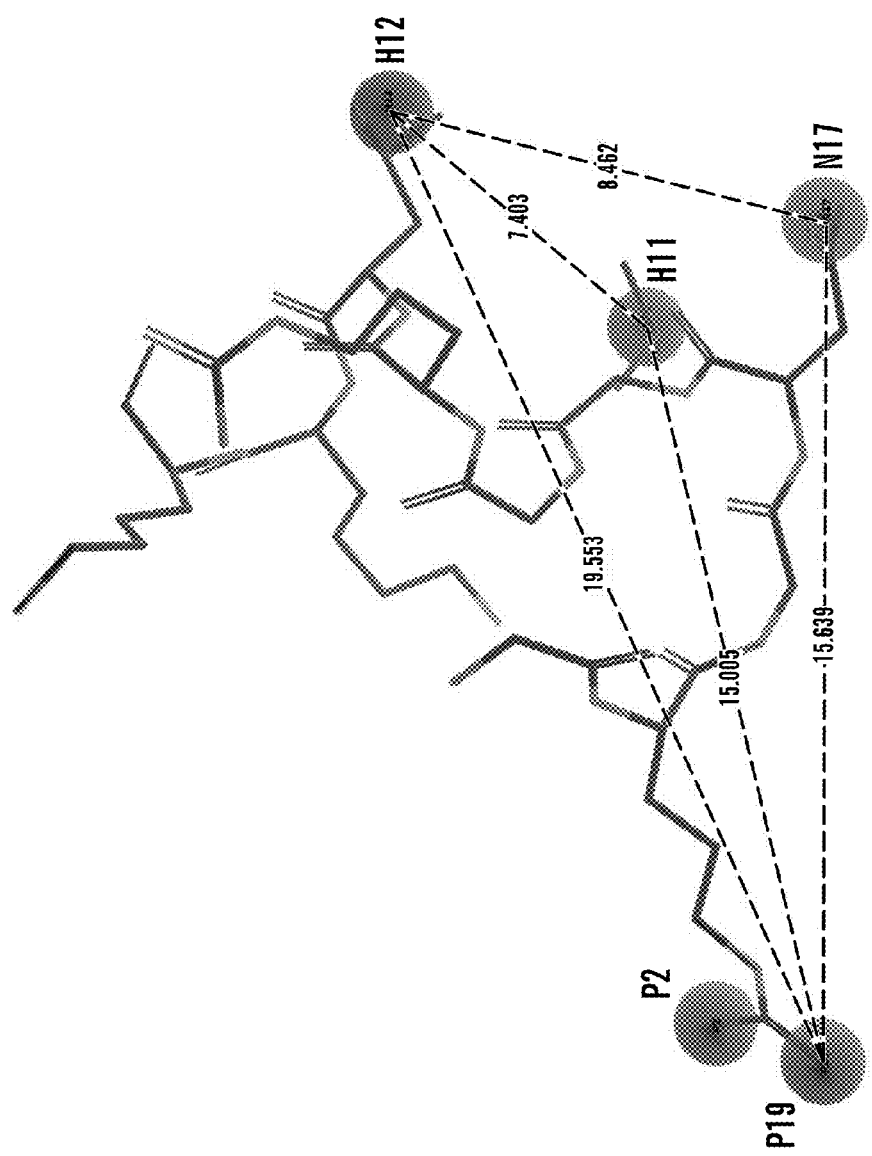
FIG. 4 shows a computer-generated docking study snapshot in which different molecular entities or functional groups of an exemplary pharmacophore model are docked into various parts of binding pocket of the crystal structure of integrin $\alpha_v\beta_6$ headpiece. Distances between the functional groups are labeled in the figure. H11 and H12 are the hydrophobic group, which can be aromatic or linear. P2 and P19 are the negative charged groups. N17 is a positive charged group when metal ion binds at integrin MIDAS, but N17 can also be a positive charged group when metal ion is absent at integrin MIDAS to replace the metal ion. There are four functional groups, and the $\angle H11P19N17=22.4°$, $\angle H11P19H12=19.4°$, $\angle H12P19N17=28.7°$, $\angle P19N17H11=70.7°$, $\angle P19N17H12=98.1°$, $\angle H11N17H12=51.1°$.

The importance of the amphipathic α-helix for binding to α$_v$β$_6$ was evaluated by helix truncation and mutation. The C-terminus of the TGF-β3 undecapeptide was truncated one residue at a time (FIG. 3B). The largest step-wise drops in affinity, about 10-fold each, occurred when Leu-244 and then Leu-247 were removed (FIG. 3B). To disrupt the α-helix conformation upon binding of pro-TGF-β1 to α$_v$β$_6$, residues Ala-220 and Thr-221, which correspond to α-helix residues Gly-245 and Arg-246 in the pro-TGF-β3 peptide and have no contact with α$_v$β$_6$, were mutated to proline. These mutations had no effect on pro-TGF-β1 expression (FIG. 3C), consistent with the postulated lack of importance of this region for structural stability. However, the double Pro mutant was deficient in ability to be activated by α$_v$β$_6$ (FIG. 3E), indicating the importance of the α-helical conformation for interaction with pro-TGF-β1.

Specificity Determinants of Integrin β Subunits

The inventors have showed specializations in an integrin β-subunit that enable ligand recognition with high affinity and specificity. α$_v$β$_6$ not only recognizes RGD, but also a LXXL/I motif that folds into an amphipathic α-helix fitting into a hydrophobic pocket composed solely of residues from the β$_6$ subunit. In contrast, complexes of α$_v$β$_3$, α$_{IIb}$β$_6$, and α$_5$β$_1$ have revealed little interaction beyond that with RGD itself (7, 9, 19). The β$_6$ hydrophobic pocket interaction with the amphipathic α-helix as shown in this Example enables α$_v$β$_6$ to achieve ~1,000-fold selectivity for pro-TGF-β over the RGD motif present in fibronectin and ~1000-fold selectivity over α$_v$β$_3$ for the recognition of pro-TGFβ.

Previously, little has been known about the contribution of integrin β subunits to ligand recognition beyond the MIDAS. The inventors presented herein that high affinity of α$_v$β$_6$ for pro-TGF-β is contributed by the βI domain β1-α1, β2-β3, and α2-α3 loops, each of which interacts in a crystal structure with an amphipathic ca-helix in the ligand. These loops are designated as the specificity-determining loops (SDL) 1, 2, and 3, according to their order in the amino acid sequence (FIGS. 2D-2H). Consistent with the structural observations on α$_v$β$_6$ bound to pro-TGF-β3 peptide described herein, the inventors demonstrated with mutations that SDL1 (β1-α1 loop) and SDL3 (α2-α3 loop) are important both for binding to pro-TGF-β1 and for its activation. SDL2 (β2-β3 loop) has previously been shown by mutation to be important for ligand selectivity by α$_v$β$_3$ and α$_v$β$_1$ (6).

In addition to contacting the amphipathic helix, the β1-α1 (SDL1) and α2-α3 (SDL3) loops contact the Gly and Asp of RGD. The SDL designation for the three loops in the βI domain that bind ligand is analogous to the complementarity determining region (CDR) designation for antibody and T cell receptor chains, which also use three surface-exposed loops to contact ligand.

SDL1 and SDL3 have the sequences D(L/V/F)SX$_1$SMX$_2$(D/N)(D/N) (SEQ ID NO: 76) and (V/I)SX$_1$NX$_2$D(A/S/T)PE (SEQ ID NO: 77), respectively (FIG. 2H). The two alanines in β$_6$ that contact pro-TGF-β are in the X$_1$ position in each loop. Variation in the X$_1$ positions of the β1-α$_1$ and α2-α3 loops correlates with variation in the entire 1 subunit in evolution (FIG. 2H) (20), indicating a paradigmatic role in overall β subunit function. Thus, the β$_6$ and β$_8$ subfamily (A in β1-α1+A/G in β2-β3), the β$_1$, β$_2$, and β$_7$ subfamily (Y+G), the β$_3$ and β$_5$ subfamily (Y/L+R), and β$_4$ (N+G) each have a unique pattern, and within a subfamily, variation is confined to chemically similar residues (A/G and Y/L). Residues in the X$_2$ position in SDL1 and SDL3 pack against and contribute to conformational variation of SDL2 (FIGS. 2F-2H). SDL1 and SDL3 also bind metal ions (asterisks, FIG. 2H), and, thus, their backbone conformations are not free to vary unless metal ions are lost, which is not consistent with ligand binding. Switching SDL3 to β$_3$-like with an Ala to Arg substitution abolished pro-TGF-β$_1$ binding and activation, while the Ala to Tyr substitution in SDL1 led to partial loss of binding and activation.

As the outermost and only non-metal binding SDL, the conformation of SDL2 is free to vary in evolution, as shown herein in a comparison between integrins with identical α-subunits, α$_v$β$_3$ and α$_v$β$_6$. Differences stem from presence of a cis-Pro in SDL2 of β$_3$ and packing interactions with X$_2$ residues in SDL1 and SDL3. Consistent with the lack of effect shown herein of two SDL2 mutations, only one of six residues between the two cysteines in SDL2 of β$_6$ and β$_8$ are identical (FIG. 2H), yet α$_v$β$_6$ and α$_v$β$_8$ bind and activate pro-TGF-β comparably well (FIG. 1A and FIG. 1B). This indicates backbone-dependent contributions of SDL2 to integrin specificity.

As integrins are important therapeutic targets, the identification of the three SDLs of integrin β-subunits not only advances the understanding of how β-subunits contribute to integrin-ligand specificity, but also the ability to rationally design antagonists.

Exemplary Material and Methods Used in Example 4

Pro-TGF-1 Cell Surface Binding and Activation.

$\alpha_v$ in a modified pEF1 vector and $\beta_1$, $\beta_3$, $\beta_5$, $\beta_6$, or $\beta_8$ mutants in pcDNA3.1 (−) vector were transiently transfected into 293T cells as described in Ref 11. Purified pro-TGF-β1 (17) was fluorescently labeled with fluorescein isothiocyanate (FITC) using the Pierce (Thermo Fisher Scientific, Rockford, Ill.) FITC labeling kit according to manufacturer's instructions. Cells were resuspended in HBS buffer (20 mM HEPES, pH 7.4, 137 mM NaCl, and 5 mM KCl, 5.5 mM glucose, and 1% bovine serum albumin) and incubated at room temperature for 30 min with 50 nM FITC-pro-TGF-β1 in the presence of either (1) 5 mM EDTA, (2) 1 mM $Mg^{2+}/Ca^{2+}$, or (3) 1 mM $Mn^{2+}/0.2$ mM $Ca^{2+}$ and subjected to flow cytometry without washing. To determine the expression of different $\alpha_v$ integrins, cells were resuspended and incubated at room temperature for 30 min with 2 μg/ml P2W7 antibody (anti $\alpha_v$, Sigma-Aldrich, St. Louis, Mo.) and then stained on ice for 30 min with FITC-anti-mouse IgG (1/500) (Sigma-Aldrich). Cells were washed once and subjected to fluorescent flow cytometry. Ligand binding was measured as the mean fluorescence intensity (MFI) of pro-TGF-β1 after subtraction of the MFI in presence of EDTA.

TGF-β assays used 293T cells transiently transfected with the $\alpha_v$ and β subunits as above along with wild-type or mutant human pro-TGF-β1 in pcDNA3.1 (−), then co-cultured with transformed mink lung cells expressing a luciferase gene under the control of a TGF-β1-inducible promoter (17, 21).

$\alpha_v\beta_6$ and $\alpha_v\beta_3$ Headpiece Expression and Purification.

Soluble $\alpha_v\beta_6$ headpiece was prepared as follows. The $\alpha_v$ headpiece (residues 1-594) with M400C mutation was followed by a 3C protease site, the ACID coiled-coil, a Strep-II tag and a His tag. $\beta_6$ headpiece residues 1-474 with I270C or $\beta_3$ headpiece residues 1-472 with Q267C were followed by the 3C site, the BASE coiled-coil, and a His tag. The Cys mutations generated a disulfide bond that prevented a/13 subunit dissociation. Proteins expressed in HEK293s Gnt I⁻ cells with Ex-Cell 293 serum free media (Sigma) were purified using Ni-NTA affinity column (Qiagen). Protein was cleaved by 3C protease at 4° C. overnight, passed through Ni-NTA resin and further purified using an ion exchange gradient from 50 mM NaCl to 1M NaCl, 20 mM Tris-HCl pH 8.0 (Q fast-flow Sepharose, GE healthcare) and gel filtration (Superdex 200, GE healthcare).

Fluorescence Anisotropy.

Fluorescence anisotropy was in 150 mM NaCl, 1 mM $Mg^{2+}/Ca^{2+}$, 20 mM HEPES, pH 7.4 or buffer at indicated pH with 5 nM fluorescence probe (FITC-pro-TGF-β3 peptide, FITC-GRGDLGRL (SEQ ID NO: 68)). Binding affinities were calculated as described in Ref. 23. In saturation binding assays, the anisotropy of the fluorescence probe was measured while $\alpha_v\beta_6$ headpiece (starting at 2.67 μM) or $\alpha_v\beta_3$ headpiece (starting at 75 μM) was serially diluted in 3-fold decrements. Competition binding assays used 200 nM $\alpha_v\beta_6$ or 4 μM $\alpha_v\beta_3$ headpiece, 5 nM of fluorescence probe, and competing peptide serially diluted in 3-fold decrement from 500 μM to 0.5 nM.

$\alpha_v\beta_6$ Headpiece Crystallization, Data Collection and Structure Determination.

$\alpha_v\beta_6$ crystals in hanging drops were formed with 3 mg/ml $\alpha_v$06 headpiece in 20 mM Tris-HCl pH 8.0, 150 mM NaCl, 1 mM $CaCl_2$) and 1 mM $MgCl_2$ buffer (1 μl) and 1 μl reservoir solution of 20% PEG 4000, 0.1 M sodium cacodylate pH 6.0, 0.2 M ammonium sulfate. Identical vol:vol mixture of the protein and crystallization buffers yields a pH of 6.5. Pro-TGF-β3 peptide (1 mM each Ac-HGRGDLGR-LKK-NH$_2$ (SEQ ID NO: 78), $MgCl_2$, and $CaCl_2$, 0.21 μl) was added to drops of ~1.5 μl (~130 μM final conc.) for 4 h before harvesting crystals. Immediately prior to flash freezing in liquid $N_2$, crystals were dipped in reservoir solution containing 25% glycerol with or without peptide, $MgCl_2$, and $CaCl_2$ each at 0.25 mM.

Diffraction data from GM/CA-CAT beamline 23-ID of Advanced Photon Source (APS) at Argonne National Laboratory were processed using XDS (24) with cross-correlation to determine the diffraction limit (25). Structures were solved using molecular replacement by PHASER (26) with the $\alpha_v\beta_3$ headpiece from PDB code 4G1E as the search model (14). The structure was refined with PHENIX (27), manually built using Coot, and validated with Molprobity (28). I/σ(I) and CC ½ in the highest resolution shell increase as a function of the number of diffraction images in plots generated with XDS. Furthermore, Rwork/Rfree of the outer shell are 38.0%/41.7% and 39.9%/44.4% for the apo and peptide soaked-models respectively (Table 1). These results show that the weak diffraction data in the outer shell contribute to structure determination.

Figure 5:
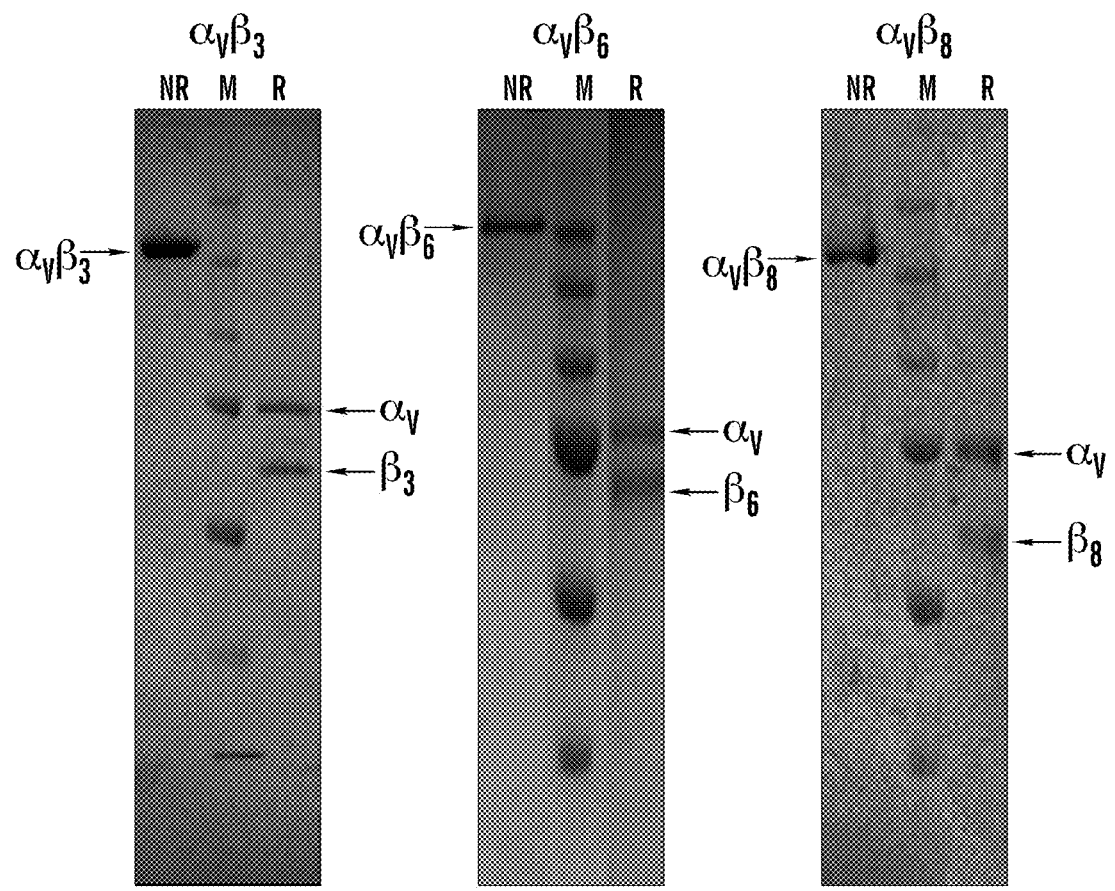
FIG. 5 shows reducing and non-reducing SDS-PAGE of modified integrin $\alpha_v\beta_3$, $\alpha_v\beta_6$, and $\alpha_v\beta_8$ headpiece dimer. NR, M, R stand for Non-reducing, Marker, and Reducing.

Example 5. Disulfide Linked $\alpha_v\beta_3$ and $\alpha_v\beta_8$ Integrin Headpiece Dimers To generate the disulfide linked $\alpha_v\beta_3$ and $\alpha_v\beta_8$ integrin headpiece dimers, any one or more of the cysteine mutations in the cav subunit as described herein can be used. In this example, amino acid residues 399-401 (Ser-Met-Pro) of SEQ ID NO: 1 was substituted with Ser-Gly-Cys-Pro (SEQ ID NO: 59) to introduce a cysteine in the $\alpha_v$ subunit. Cysteines were introduced in the $\beta_3$ subunit and the $\beta_8$ subunit in the same position structurally as in the $\beta_6$ subunit. That is, amino acid residue 293 (Gln) of SEQ ID NO: 5 was mutated to Cys in the $\beta_3$ subunit (SEQ ID NO: 5 includes the signal peptide sequence at positions 1-26. Without the signal peptide sequence, the numbering of the amino acid residue Gin being substituted with Cys is counted as amino acid residue 267), and amino acid residue 301 (Val) of SEQ ID NO: 6 was mutated to Cys in the $\beta_8$ subunit (SEQ ID NO: 6 includes the signal peptide sequence at positions 1-42. Without the signal peptide sequence, the numbering of the amino acid residue Val being substituted with Cys is counted as amino acid residue 259). Stable cell lines secreting integrin heterodimers were produced using a similar protocol for expressing $\alpha_v\beta_6$ as described in Example 4 above, and the heterodimer material was purified in good quantities. The modified $\alpha_v\beta_3$ and $\alpha_v\beta_8$ integrin headpiece dimers were formed with disulfide bond(s) cross-linking the α and β subunits, as in $\alpha_v\beta_6$, as confirmed by reducing and non-reducing SDS page (FIG. 5). Without wishing to be bound by the theory, as the α and β subunits are crosslinked to each other by at least one or more disulfide bonds to form a heterodimer, the disulfide linked integrin heterodimer generally has a better yield than the wildtype integrin, which is non-covalently linked and is thus reversible.

Example 6. Disulfide Linked 3-Domain Integrin Headpiece Fragment

Generally, a wild-type integrin α headpiece polypeptide includes β-propeller domain and a thigh domain, while a wild-type integrin β headpiece polypeptide generally includes a βI domain, a hybrid domain, a PSI (plexin, semaphoring, and integrin) domain, and an I-EGF-1 domain.

Figure 6:
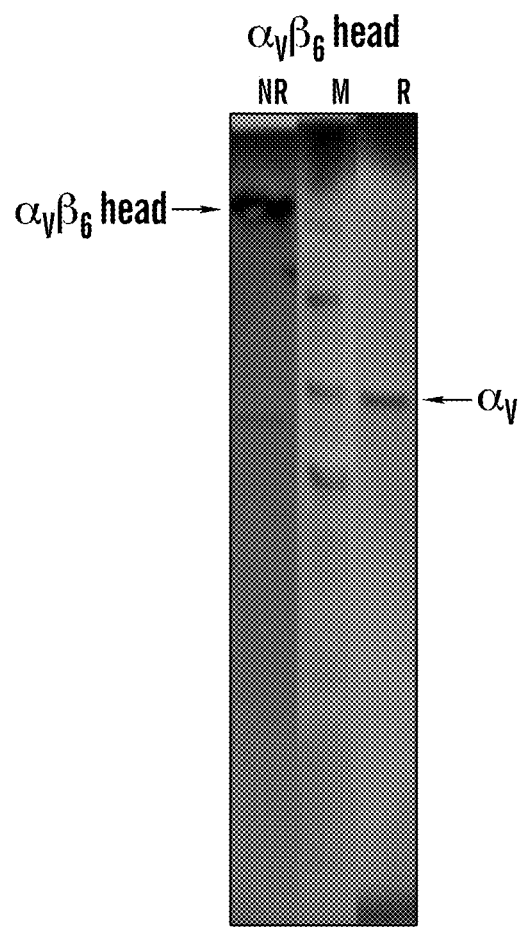
FIG. 6 shows reducing and non-reducing SDS-PAGE of modified integrin $\alpha_v\beta_6$ 3-domain fragment dimer. NR, M, R stand for Non-reducing, Marker, and Reducing.
Figure 8:
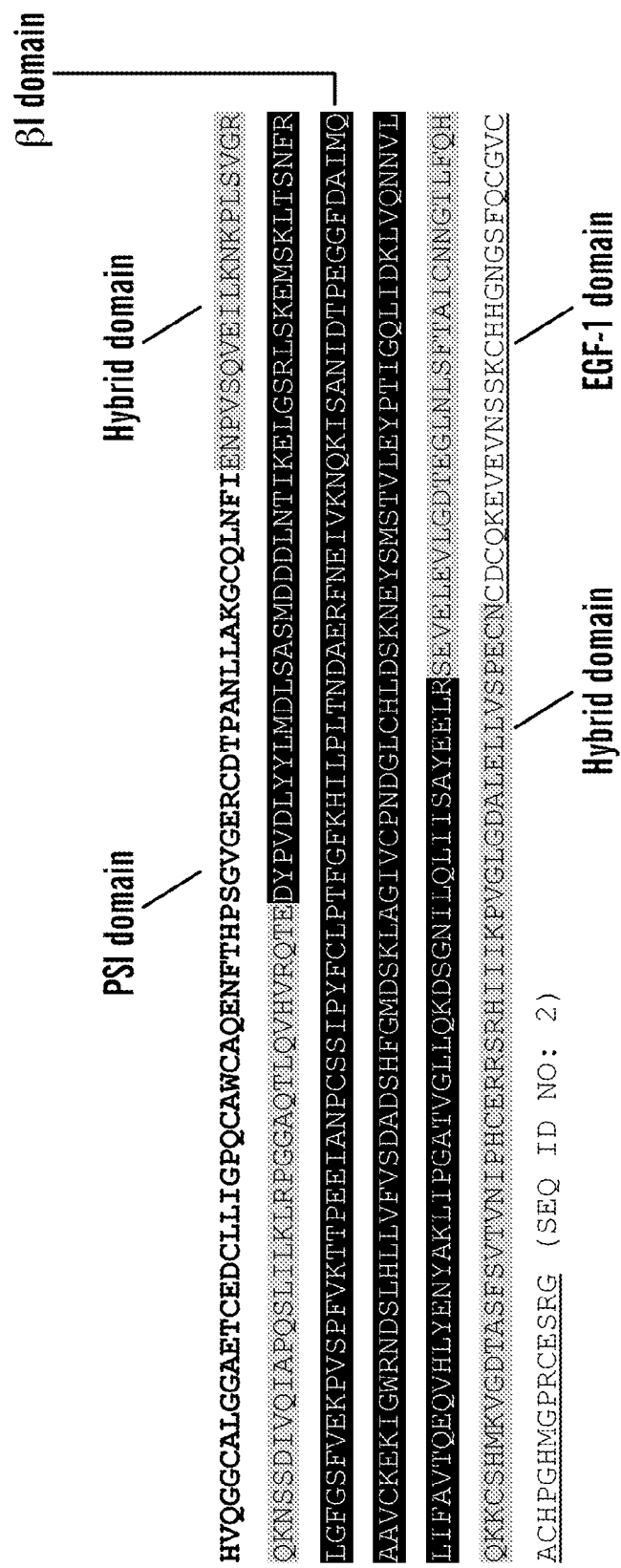
FIG. 8 shows an amino acid sequence of an integrin $\beta_6$ subunit. The PSI domain is highlighted in bold. The hybrid domain is highlighted in grey. The βI domain is highlighted in black. The EGF-1 domain is underlined.
Figure 9:
FIG. 9 shows an amino acid sequence of an integrin $\beta_3$ subunit. The signal sequence is indicated in a line box. The PSI domain is highlighted in bold. The hybrid domain is highlighted in grey. The βI domain is highlighted in black. The EGF-1 domain is underlined.

Here, the inventors have surprisingly discovered that a 3-domain integrin fragment of the $\alpha_v\beta_8$ headpiece dimer, which contains only the $\alpha_v$ β-propeller and thigh domains and the $\beta_6$ βI domain, and is crosslinked using a disulfide bond as described herein, can be generated with good expression. Such an integrin fragment has never been previously made in good yield, but the inventors was successfully able to express such a 3-domain integrin fragment by introducing a disulfide bond to crosslink the α headpiece fragment and the β headpiece fragment (FIG. 6). In one embodiment, the $\alpha_v$ headpiece has an amino acid sequence of SEQ ID NO: 1 with a M400C mutation and the $\beta_6$ βI domain has an I270C mutation (the numbering is based on SEQ ID NO: 2). The amino acid sequence of the 036 βI domain is shaded in black as shown in FIG. 8 (starting from DYP . . . ELR of SEQ ID NO: 2). The binding affinity of the 3-domain $\alpha_v\beta_6$ integrin fragment to pro-TGF-β1 was measured, e.g., by Biacore, and then compared to that of the corresponding full headpiece. The $K_d$ of 3-domain $\alpha_v\beta_6$ integrin fragment is 0.18±0.02 nM, while the $K_d$ of the corresponding full headpiece is 8.2±2.0 nM.

Example 7. Improved Crystal Resolution of Modified $\alpha_v\beta_3$, $\alpha_v\beta_6$, and $\alpha_v\beta_8$ Integrin Dimers With the disulfide bond modified integrin dimers as described in the previous Examples, the resolution of integrin $\alpha_v\beta_3$, $\alpha_v\beta_6$, and $\alpha_v\beta_8$ crystals have been greatly improved. The crystal structure of $\alpha_v\beta_3$ has been previously shown only at a resolution of around 3 Å or higher. However, the inventors were able to obtain a higher-resolution crystal structure of $\alpha_v\beta_3$, $\alpha_v\beta_6$, and $\alpha_v\beta_8$ using the modified integrin headpiece with one or more disulfide bonds. With the disulfide linked $\alpha_v\beta_3$ integrin dimer, a resolution as high as about 1.9 Å was even obtained. Data on representative integrin crystal structures are shown in Table 6.

Figure 7A:
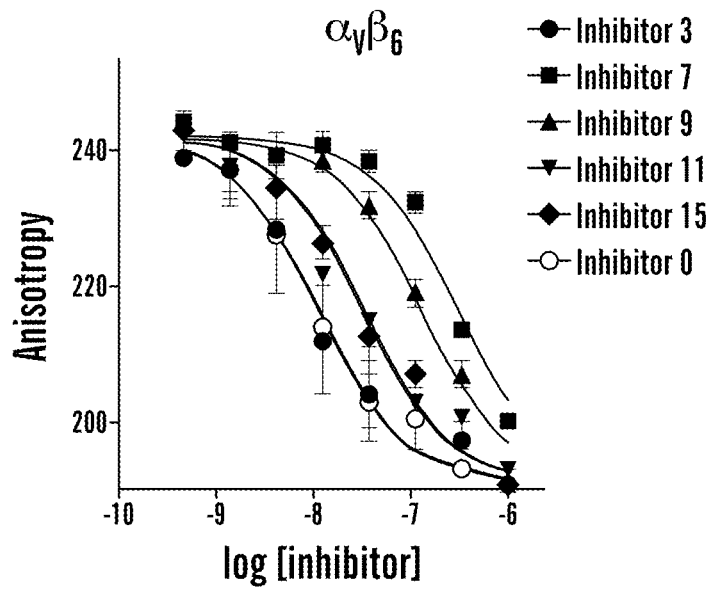
FIGS. 7A-7B are graphs showing competitive binding affinities of indicated inhibitors to modified integrin $\alpha_v\beta_6$ (FIG. 7A) and $\alpha_v\beta_8$ (FIG. 7B) headpiece dimer. Fluorescence anisotropy data are mean±SEM of triplicate samples scaled logarithmically.
Figure 7B:
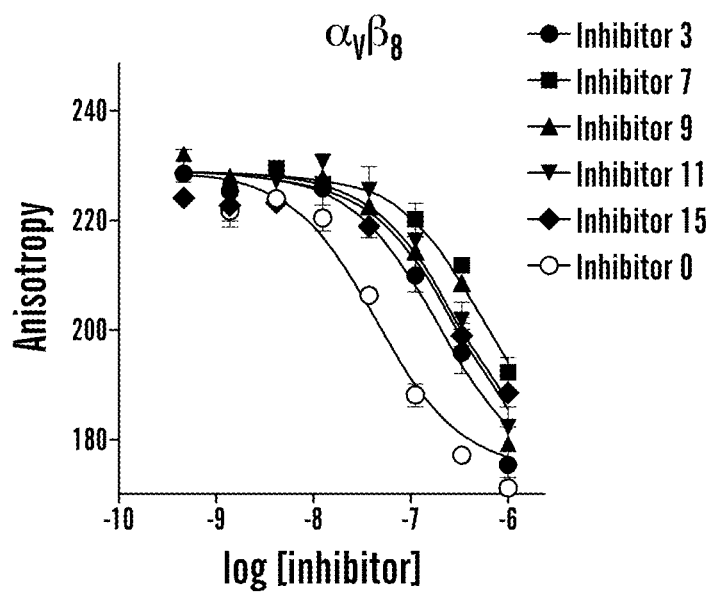

Example 8. Example Use of the Modified Integrin Polypeptide Dimers to Screen for Novel Inhibitory Drugs Competition binding assays combined with fluorescence anisotropy assays were performed to determine binding affinity of each candidate inhibitor to the appropriate integrin. Competition binding assays used 200 nM $\alpha_v\beta_6$ or 300 nM $\alpha_v\beta_8$ headpiece, 5 nM of fluorescence probe (the same probe as used in Example 4, e.g., FITC-pro-TGF-β3 peptide or FITC-GRGDLGRL) as a competing peptide, and a candidate inhibitor serially diluted from 200 nM to 0.1 nM. FIGS. 7A-7B show fluorescence anisotropy data of each indicated test indicator. Binding affinities of each test inhibitor were calculated as described in Rossi et al. (2011) Nat. Protoc. 6: 365, and shown in Table 7 below. The smaller the $K_d$ value is, the stronger the binding affinity of the test inhibitor to the target integrin, and thus the more potent its inhibitory effect is.

TABLE 7

Computed $K_d$ values of each indicated inhibitor for the modified $\alpha_v\beta_6$ and $\alpha_v\beta_8$ integrin polypeptide dimers described herein

| | (nM) | | | | | |
|---|---|---|---|---|---|---|
| | Inhibitor 0 | Inhibitor 3 | Inhibitor 7 | Inhibitor 9 | Inhibitor 11 | Inhibitor 15 |
| αvβ6 | 2.6 | 2.6 | 89.8 | 37.5 | 8.1 | 9.3 |
| αvβ8 | 7.6 | 37.5 | 124 | 113 | 66.9 | 54.7 |

REFERENCES

All references cited herein, in the specification and Examples are incorporated in their entirety by reference.

TABLE 6

Statistincs of X-ray diffraction and structure refinement

| | αvβ3 | αvβ6 | αvβ8 |
|---|---|---|---|
| Data collection | | | |
| Space group | P2$_1$2$_1$2$_1$ | C2 | P1 |
| α, β, γ ° | 90, 90, 90 | 90, 90, 98.7 | 90, 90, 110.0 |
| Unit cell (a, b, c) Å | 87.1, 124.1, 165.3 | 184.4, 170.0, 102.4 | 153.1, 55.3, 181.9 |
| Resolution range (Å) | 50.0-1.90 (1.95-1.90)$^a$ | 50.0-2.50 (2.67-2.50) | 50.0-2.90 (2.98-2.90) |
| Completeness (%) | 95.0 (95.9) | 94.4 (70.6) | 94.6 (88.6) |
| Number reflections | 259,318 (19,402) | 87,425 (5,641) | 118,116 (8,128) |
| Redundancy | 1.8 (1.8) | 2.3 (2.1) | 1.9 (1.9) |
| R$_{merge}$ (%) $^b$ | 11.3 (149) | 11.6 (233) | 18.6 (288) |
| I/σ(I) | 6.5 (0.57) | 4.9 (0.35) | 4.4 (0.27) |
| CC$_{1/2}$ (%)$^c$ | 99.6 (17.2) | 98.3 (10.4) | 97.8 (13.6) |
| Wavelength (Å) | 1.0332 | 1.0332 | 1.0332 |
| Refinement | | | |
| R$_{work}$ (%)$^d$ | 19.2 | 23.6 | |
| R$_{free}$ (%) | 22.4 | 27.9 | |
| Bond RMSD (Å) | 0.009 | 0.005 | |
| Angle RMSD (°) | 1.13 | 0.76 | |
| Ramachandran plot$^e$ (Favored/allowed/outlier) | 96.5/3.5/0.0 | 95.7/4.1/0.2 | |

$^a$The numbers in parentheses refer to the highest resolution shell.
$^b$ Rmerge = Σh Σi|Ii(h) − <I(h)>|/ΣhΣi|Ii(h), where Ii(h) and <I(h)> are the i$^{th}$ and mean measurement of the intensity of reflection h.
$^c$Pearson's correlation coefficient between average intensities of random half-datasets for unique reflection.
$^d$Rfactor = Σh||Fobs (h)| − |Fcalc (h)||/Σh|Fobs (h)|, where Fobs (h) and F calc (h) are the observed and calculated structure factors, respectively. No I/σ(I) cutoff was applied.
$^e$Calculated with MolProbity.

1. R. O. Hynes, Integrins: bi-directional, allosteric, signalling machines. Cell 110, 673 (2002).
2. J. S. Munger et al., The integrin αvβ6 binds and activates latent TGFβ1: A mechanism for regulating pulmonary inflammation and fibrosis. Cell 96, 319 (1999).
3. D. Mu et al., The integrin αvβ8 mediates epithelial homeostasis through MT1-MMP-dependent activation of TGF-β1. J. Cell Biol. 157, 493 (2002).
4. M. M. Shull et al., Targeted disruption of the mouse transforming growth factor-β1 gene results in multifocal inflammatory disease. Nature 359, 693 (1992).
5. Z. Yang et al., Absence of integrin-mediated TGFβ1 activation in vivo recapitulates the phenotype of TGFβ1-null mice. J. Cell Biol. 176, 787 (2007).
6. J. Takagi, T. Kamata, J. Meredith, W. Puzon-McLaughlin, Y. Takada, Changing ligand specificities of αvβ1 and αvβ3 integrins by swapping a short diverse sequence of the β subunit. J. Biol. Chem. 272, 19794 (1997).
7. J. P. Xiong et al., Crystal structure of the extracellular segment of integrin αVβ3 in complex with an Arg-Gly-Asp ligand. Science 296, 151 (2002).
8. T. Xiao, J. Takagi, J.-h. Wang, B. S. Coller, T. A. Springer, Structural basis for allostery in integrins and binding of fibrinogen-mimetic therapeutics. Nature 432, 59 (2004).
9. M. Nagae et al., Crystal structure of α5β1 integrin ectodomain: Atomic details of the fibronectin receptor. J. Cell Biol. 197, 131 (2012).
10. M. Sen, K. Yuki, T. A. Springer, An internal ligand-bound, metastable state of a leukocyte integrin, αXβ2. J. Cell Biol. 203, 629 (2013).
11. R. Wang et al., GARP regulates the bioavailability and activation of TGF-β. Mol. Biol. Cell 23, 1129 (2012).
12. J.-P. Xiong et al., Crystal structure of the extracellular segment of integrin αVβ3. Science 294, 339 (2001).
13. J. Zhu et al., Structure of a complete integrin ectodomain in a physiologic resting state and activation and deactivation by applied forces. Mol. Cell 32, 849 (2008).
14. X. Dong et al., αVβ3 integrin crystal structures and their functional implications. Biochemistry 51, 8814 (2012).
15. J. Zhu, J. Zhu, T. A. Springer, Complete integrin headpiece opening in eight steps. J. Cell Biol. 201, 1053 (2013).
16. P. Paroutis, N. Touret, S. Grinstein, The pH of the secretory pathway: measurement, determinants, and regulation. Physiology (Bethesda) 19, 207 (2004).
17. M. Shi et al., Latent TGF-β structure and activation. Nature 474, 343 (2011).
18. R. Acharya et al., The three-dimensional structure of foot-and-mouth disease virus at 2.9 Å resolution. Nature 337, 709 (1989).
19. T. A. Springer, J. Zhu, T. Xiao, Structural basis for distinctive recognition of fibrinogen by the platelet integrin αIIbβ3. J. Cell Biol. 182, 791 (2008).
20. M. Huhtala, J. Heino, D. Casciari, A. de Luise, M. S. Johnson, Integrin evolution: insights from ascidian and teleost fish genomes. Matrix Biol. 24, 83 (2005).
21. M. Abe et al., An assay for transforming growth factor-beta using cells transfected with a plasminogen activator inhibitor-1 promoter-luciferase construct. Anal. Biochem. 216, 276 (1994).
22. Y. Yu, T. Schurpf, T. A. Springer, How natalizumab binds and antagonizes α4 integrins. J. Biol. Chem. 288, 32314 (2013).
23. A. M. Rossi, C. W. Taylor, Analysis of protein-ligand interactions by fluorescence polarization. Nat. Protoc. 6, 365 (2011).
24. W. Kabsch, in International Tables for Crystallography, M. G. Rossmann, E. Arnold, Eds. (Dordrecht: Kluwer Academic Publishers., 2001), pp. 730-734.
25. P. A. Karplus, K. Diederichs, Linking crystallographic model and data quality. Science 336, 1030 (2012).
26. A. J. McCoy et al., Phaser crystallographic software. J Appl Crystallogr 40, 658 (2007).
27. P. D. Adams et al., PHENIX: a comprehensive Python-based system for macromolecular structure solution. Acta Crystallogr. D Biol. Crystallogr. 66, 213 (2010).
28. I. W. Davis et al., MolProbity: all-atom contacts and structure validation for proteins and nucleic acids. Nucleic Acids Res. 35, W375 (2007).

```
                                SEQUENCE LISTING (SEQ ID NO: 1)
FNLDVDSPAEYSGPEGSYFGFAVDFFVPSASSRMFLLVGAPKANTTQPGIVEGGQVLKCDWSSTRRCQPIEFDATGN

RDYAKDDPLEFKSHQWFGASVRSKQDKILACAPLYHWRTEMKQEREPVGTCFLQDGTKTVEYAPCRSQDIDADGQGF

CQGGFSIDFTKADRVLLGGPGSFYWQGQLISDQVAEIVSKYDPNVYSIKYNNQLATRTAQAIFDDSYLGYSVAVGDF

NGDGIDDFVSGVPRAARTLGMVYIYDGKNMSSLYNFTGEQMAAYFGFSVAATDINGDDYADVFIGAPLFMDRGSDGK

LQEVGQVSVSLQRASGDFQTTKLNGFEVFARFGSAIAPLGDLDQDGENDIAIAAPYGGEDKKGIVYIFNGRSTGLNA

VPSQILEGQWAARSGCPPSEGYSMKGATDIDKNGYPDLIVGAFGVDRAILYRARPVITVNAGLEVYPSILNQDNKTC

SLPGTALKVSCFNVRFCLKADGKGVLPRKLNFQVELLLDKLKQKGAIRRALFLYSRSPSHSKNMTISRGGLMQCEEL

IAYLRDESEFRDKLTPITIFMEYRLDYRTAADTTGLQPILNQFTPANISRQAHILLDTGG (SEQ ID NO: 2)
HVQGGCALGGAETCEDCLLIGPQCAWCAQENFTHPSGVGERCDTPANLLAKGCQLNFIENPVSQVEILKNKPLSVGR

QKNSSDIVQIAPQSLILKLRPGGAQTLQVHVRQTEDYPVDLYYLMDLSASMDDDLNTIKELGSRLSKEMSKLTSNFR

LGFGSFVEKPVSPFVKTTPEEIANPCSSIPYFCLPTFGFKHILPLTNDAERFNEIVKNQKISANIDTPEGGFDAIMQ

AAVCKEKIGWRNDSLHLLVFVSDADSHFGMDSKLAGIVCPNDGLCHLDSKNEYSMSTVLEYPTIGQLIDKLVQNNVL

LIFAVTQEQVHLYENYAKLIPGATVGLLQKDSGNILQLIISAYEELRSEVELEVLGDTEGLNLSFTAICNNGTLFQH
```

QKKCSHMKVGDTASFSVTVNIPHCERRSRHIIIKPVGLGDALELLVSPECNCDCQKEVEVNSSKCHHGNGSFQCGVC
ACHPGHMGPRCESRG (SEQ ID NO: 3)

```
  1 MGSRTPESPL HAVQLRWGPR RRPPLLPLLL LLLPPPPRVG GFNLDAEAPA VLSGPPGSFF

61 GFSVEFYRPG TDGVSVLVGA PKANTSQPGV LQGGAVYLCP WGASPTQCTP IEFDSKGSRL

121 LESSLSSSEG EEPVEYKSLQ WFGATVRAHG SSILACAPLY SWRTEKEPLS DPVGTCYLST

181 DNFTRILEYA PCRSDFSWAA GQGYCQGGFS AEFTKTGRVV LGGPGSYFWQ GQILSATQEQ

241 IAESYYPEYL INLVQGQLQT RQASSIYDDS YLGYSVAVGE FSGDDTEDFV AGVPKGNLTY

301 GYVTILNGSD IRSLYNFSGE QMASYFGYAV AATDVNGDGL DDLLVGAPLL MDRTPDGRPQ

361 EVGRVYVYLQ HPAGIEPTPT LTLTGHDEFG RFGSSLTPLG DLDQDGYNDV AIGAPFGGET

421 QQGVVFVFPG GPGGLGSKPS QVLQPLWAAS HTPDFFGSAL RGGRDLDGNG YPDLIVGSFG

481 VDKAVVYRGR PIVSASASLT IFPAMFNPEE RSCSLEGNPV ACINLSFCLN ASGKHVADSI

541 GFTVELQLDW QKQKGGVRRA LFLASRQATL TQTLLIQNGA REDCREMKIY LRNESEFRDK

601 LSPIHIALNF SLDPQAPVDS HGLRPALHYQ SKSRIEDKAQ ILLDCGEDNI CVPDLQLEVF

661 GEQNHVYLGD KNALNLTFHA QNVGEGGAYE AELRVTAPPE AEYSGLVRHP GNFSSLSCDY

721 FAVNQSRLLV CDLGNPMKAG ASLWGGLRFT VPHLRDTKKT IQFDFQILSK NLNNSQSDVV

781 SFRLSVEAQA QVTLNGVSKP EAVLFPVSDW HPRDQPQKEE DLGPAVHHVY ELINQGPSSI

841 SQGVLELSCP QALEGQQLLY VTRVTGLNCT TNHPINPKGL ELDPEGSLHH QQKREAPSRS

901 SASSGPQILK CPEAECFRLR CELGPLHQQE SQSLQLHFRV WAKTFLQREH QPFSLQCEAV

961 YKALKMPYRI LPRQLPQKER QVATAVQWTK AEGSYGVPLW IIILAILFGL LLLGLLIYIL

1021 YKLGFFKRSL PYGTAMEKAQ LKPPATSDA
```

(SEQ ID NO: 4)

```
  1 mnlqpifwig lissvccvfa qtdenrclka nakscgeciq agpncgwctn stflqegmpt 61 sarcddleal kkkgcppddi enprgskdik knknvtnrsk gtaeklkped itgiqpqqlv 121 lrlrsgepqt ftlkfkraed ypidlyylmd lsysmkddle nvkslgtdlm nemrritsdf 181 rigfgsfvek tvmpyisttp aklrnpctse qnctspfsyk nvlsltnkge vfnelvgkqr 241 isgnldspeg gfdaimqvav cgsligwrnv trllvfstda gfhfagdgkl ggivlpndgq 301 chlennmytm shyydypsia hlvqklsenn igtifavtee fqpvykelkn lipksavgtl 361 sanssnviql iidaynslss evilengkls egvtisyksy ckngvngtge ngrkcsnisi 421 gdevqfeisi tsnkcpkkds dsfkirplgf teevevilqy icececgseg ipespkcheg 481 ngtfecgacr cnegrvgrhc ecstdevnse dmdaycrken sseicsnnge cvcgqcvcrk 541 rdntneiysg kfcecdnfnc drsnglicgg ngvckcrvce cnpnytgsac dcsldtstce 601 asngqicngr gicecgvckc tdpkfqgqtc emcgtolgvc aehkecvqcr afnkgekkdt 661 ctqecsyfni tkvesrdklp qpvqpdpvsh ckekdvddcw fyftysvngn nevmvhvven 721 pecptgpdii pivagvvagi vliglallli wkllmiihdr refakfekek mnakwdtgen 781 piyksavttv vnpkyegk
```

(SEQ ID NO: 5)

```
  1 mrarprprpl watvlalgal agvgvg gpni cttrgvsscq qclavspmca wcsdealplg 61 sprodlkenl lkdncapesi efpvsearvl edrplsdkgs gdssqvtqvs pqrialrlrp
```

```
    121  ddsknfsiqv  rqvedypvdi  yylmdlsysm  kddlwsignl  gtklatqmrk  ltsnlrigfg 181  afvdkpvspy  myisppeale  npcydmkttc  lpmfgykhvl  tltdqvtrfn  eevkkqsysr 241  nrdapeggfd  aimqatvcde  kigwrndash  llvfttdakt  hialdgrlag  ivqpndgqch 301  vgsdnhysas  ttmdypslgl  mteklsqkni  nlifavtenv  vnlyqnysel  ipgttvgvls 361  mdssnvlgli  vdaygkirsk  velevrdlpe  elslsfnatc  lnnevipglk  scmglkigdt 421  vsfsieakvr  gcpqekeksf  tikpvgfkds  livqvtfdcd  cacqaqaepn  shrcnngngt 481  fecgvcrcgp  gwlgsqcecs  eedyrpsqqd  ecspregqpv  csgrgeclog  qcvchssdfg 541  kitgkycecd  dfscvrykge  mcsghgqcsc  gdclcdsdwt  gyycncttrt  dtcmssngll 601  csgrgkcecg  scvciqpgsy  gdtcekcptc  pdactfkkec  veckkfdrga  lhdentcnry 661  crdeiesvke  lkdtgkdavn  ctykneddcv  vrfqyyedss  gksilyvvee  pecpkgpdil 721  vvllsvmgai  lliglaalli  wkllitihdr  kefakfeeer  arakwdtann  plykeatstf 781  tnityrgt (SEQ ID NO: 6)
      1  mcgsalafft  aafvclqndr  rgpasflwaa  wvfslvlglg  qg ednrcass  naascarcla 61  lgpecgwcvq  edfisggsrs  ercdivsnli  skgcsvdsie  ypsvhviipt  eneintqvtp 121  gevsiqlrpg  aeanfmlkvh  plkkypvdly  ylvdvsasmh  nnieklnsvg  ndlsrkmaff 181  srdfrlgfgs  yvdktvspyi  sihperihnq  csdynldcmp  phgyihvlsl  tenitefeka 241  vhrqkisgni  dtpeggfdam  lqaavceshi  gwrkeakrll  lvmtdqtshl  aldsklagiv 301  vpndgnchlk  nnvyvksttm  ehpslgqlse  klidnninvi  favqgkqfhw  ykdllpllpg 361  tiageieska  anlnnlvvea  yqklisevkv  gvenqvggiy  fnitaicpdg  srkpgmegcr 421  nvtsndevlf  nvtvtmkkcd  vtggknyaii  kpigfnetak  ihihrncscq  cednrgpkgk 481  cvdetfldsk  cfqcdenkch  fdedqfsses  ckshkdqpvc  sgrgvcvcgk  cschkiklgk 541  vygkycekdd  fscpyhhgnl  caghgeceag  rcqcfsgweg  drcqcpsaaa  qhcvnskgqv 601  csgrgtcvcg  rcectdprsi  grfcehcptc  ytackenwnc  mgclhphnls  gaildqckts 661  calmeqqhyv  dqtsecfssp  sylriffiif  ivtfligllk  vliirqvilq  wnsnkiksss 721  dyrvsaskkd  klilgsvctr  avtyrrekpe  eikmdiskln  ahetfrcnf
```

An exemplary amino acid sequence of a modified integrin α_v headpiece polypeptide described herein (comprising a β-propeller domain and a thigh domain) (upon 3C protease site cutting). The underlined is the substitution introduced to permit a disulfide bond.

(SEQ ID NO: 131)
FNLDVDSPAEYSGPEGSYFGFAVDFFVPSASSRMFLLVGAPKANTTQPGI

VEGGQVLKCDWSSTRRCQPIEFDATGNRDYAKDDPLEFKSHQWFGASVRS

KQDKILACAPLYHWRTEMKQEREPVGICFLQDGTKTVEYAPCRSQDIDAD

GQGFCQGGFSIDFTKADRVLLGGPGSFYWQGQLISDQVAEIVSKYDPNVY

SIKYNNQLATRTAQAIFDDSYLGYSVAVGDFNGDGIDDFVSGVPRAARTL

GMVYIYDGKNMSSLYNFTGEQMAAYFGFSVAATDINGDDYADVFIGAPLF

MDRGSDGKLQEVGQVSVSLQRASGDFQTTKLNGFEVFARFGSAIAPLGDL

-continued

DQDGFNDIAIAAPYGGEDKKGIVYIFNGRSTGLNAVPSQILEGQWAAR<u>SG</u>

<u>C</u>PPSFGYSMKGATDIDKNGYPDLIVGAFGVDRAILYRARPVITVNAGLEV

YPSILNQDNKTCSLPGTALKVSCFNVRFCLKADGKGVLPRKLNFQVELLL

DKLKQKGAIRRALFLYSRSPSHSKNMTISRGGLMQCEELIAYLRDESEFR

DKLTPITIFMEYRLDYRTAADTTGLQPILNQFTPANISRQAHILLDTGGL

EVLFQ

An exemplary amino acid sequence of a purified, modified integrin β_6 headpiece polypeptide described herein (comprising (i) a βI domain without other domains (i.e., no hybrid domain, no PSI domain, and no EGF-1 domain) and (ii) a detectable label such as His_6 Tag (SEQ ID NO: 132) in the sequence below). The His_6 Tag can be uncleavable. The underlined is the substitution introduced to permit a disulfide bond.

(SEQ ID NO: 133)
QTEDYPVDLYYLMDLSASMDDDLNTIKELGSRLSKEMSKLTSNFRLGFGS

FVEKPVSPFVKTTPEEIANPCSSIPYFCLPTFGFKHILPLTNDAERFNEI

VKNQKISANIDTPEGGFDAIMQAAVCKEKIGWRNDSLHLLVFVSDADSHF

GMDSKLAGIVCPNDGLCHLDSKNEYSMSTVLEYPTIGQLIDKLVQNNVLL

IFAVTQEQVHLYENYAKLIPGATVGLLQKDSGNILQLIISAYEELRSEHH

HHHH

An exemplary amino acid sequence of a purified, modified integrin $\beta_8$ headpiece polypeptide described herein (comprising (i) a βI domain and a hybrid domain without other domains (i.e., no PSI domain and no EGF-1 domain). The underlined is the substitution introduced to permit a disulfide bond.

(SEQ ID NO: 134)
SKGCSVDSIEYPSVHVIIPTENEINTQVTPGEVSIQLRPGAEANFMLKVH

PLKKYPVDLYYLVDVSASMHNNIEKLNSVGNDLSRKMAFFSRDERLGFGS

YVDKTVSPYISIHPERIHNQCSDYNLDCMPPHGYIHVLSLTENITEFEKA

VHRQKISGNIDTPEGGFDAMLQAAVCESHIGWRKEAKRLLLVMTDQTSHL

ALDSKLAGIVVPNDGNCHLKNNVYVKSTTMEHPSLGQLSEKLIDNNINVI

FAVQGKQFHWYKDLLPLLPGTIAGEIESKAANLNNLVVEAYQKLISEVKV

QVENQVQGIYFNITAICPDGSRKPGMEGCRNVTSNDEVLFNVTVTMKKCD

VTGGKNYAIIKPIGFNETAKIHIHRNCSSRGLQTLFQ

An exemplary amino acid sequence of a purified, modified integrin $\beta_6$ headpiece polypeptide described herein (comprising a full headpiece including a βI domain, a hybrid domain, a PSI domain, and an EGF-1 domain).

(SEQ ID NO: 135)
HVQGGCALGGAETCEDCLLIGPQCAWCAQENFTHPSGVGERCDTPANLLA

KGCQLNFIENPVSQVEILKNKPLSVGRQKNSSDIVQIAPQSLILKLRPGG

AQTLQVHVRQTEDYPVDLYYLMDLSASMDDDLNTIKELGSRLSKEMSKLT

SNFRLGFGSFVEKPVSPFVKTTPEEIANPCSSIPYFCLPTFGFKHILPLT

NDAERFNEIVKNQKISANIDTPEGGFDAIMQAAVCKEKIGWRNDSLHLLV

FVSDADSHFGMDSKLAGIVCPNDGLCHLDSKNEYSMSTVLEYPTIGQLID

KLVQNNVLLIFAVTQEQVHLYENYAKLIPGATVGLLQKDSGNILQLIISA

YEELRSEVELEVLGDTEGLNLSFTAICNNGTLFQHQKKCSHMKVGDTASF

SVTVNIPHCERRSRHIIIKPVGLGDALELLVSPECNCDCQKEVEVNSSKC

HHGNGSFQCGVCACHPGHMGPRCESRGLQTLFQ

An exemplary amino acid sequence of a purified, modified integrin $\beta_3$ headpiece polypeptide described herein (comprising a full headpiece including a βI domain, a hybrid domain, a PSI domain, and an EGF-1 domain).

(SEQ ID NO: 136)
GPNICTTRGVSSCQQCLAVSPMCAWCSDEALPLGSPRCDLKENLLKDNCA

PESIEFPVSEARVLEDRPLSDKGSGDSSQVTQVSPQRIALRLRPDDSKNF

SIQVRQVEDYPVDIYYLMDLSYSMKDDLWSIQNLGTKLATQMRKLTSNLR

IGFGAFVDKPVSPYMYISPPEALENPCYDMKTTCLPMFGYKHVLTLTDQV

TRFNEEVKKQSVSRNRDAPEGGFDAIMQATVCDEKIGWRNDASHLLVFTT

DAKTHIALDGRLAGIVQPNDGQCHVGSDNHYSASTTMDYPSLGLMTEKLS

QKNINLIFAVTENVVNLYQNYSELIPGTTVGVLSMDSSNVLQLIVDAYGK

IRSKVELEVRDLPEELSLSFNATCLNNEVIPGLKSCMGLKIGDTVSFSIE

AKVRGCPQEKEKSFTIKPVGFKDSLIVQVTFDCDCACQAQAEPNSHRCNN

GNGTFECGVCRCGPGWLGSQCESRGLQTLFQ

An exemplary amino acid sequence of a purified, modified integrin $\beta_8$ headpiece polypeptide described herein (comprising a full headpiece including a βI domain, a hybrid domain, a PSI domain, and an EGF-1 domain).

(SEQ ID NO: 137)
EDNRCASSNAASCARCLALGPECGWCVQEDFISGGSRSERCDIVSNLISK

GCSVDSIEYPSVHVIIPTENEINTQVTPGEVSIQLRPGAEANFMLKVHPL

KKYPVDLYYLVDVSASMHNNIEKLNSVGNDLSRKMAFFSRDFRLGFGSYV

DKTVSPYISIHPERIHNQCSDYNLDCMPPHGYIHVLSLTENITEFEKAVH

RQKISGNIDTPEGGFDAMLQAAVCESHIGWRKEAKRLLLVMTDQTSHLAL

DSKLAGIVVPNDGNCHLKNNVYVKSTTMEHPSLGQLSEKLIDNNINVIFA

VQGKQFHWYKDLLPLLPGTIAGEIESKAANLNNLVVEAYQKLISEVKVQV

ENQVQGIYFNITAICPDGSRKPGMEGCRNVTSNDEVLFNVTVTMKKCDVT

GGKNYAIIKPIGFNETAKIHIHRNCSCQCEDNRGPKGKCVDETFLDSKCF

QCDENKSRGLQTLFQ

---

SEQUENCE LISTING (137 sequences)

SEQ ID NO: 1 - protein, 599 aa, Homo sapiens
FNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSGCPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDTGG

SEQ ID NO: 2 - protein, 477 aa, Artificial Sequence
  Description of Artificial Sequence: Synthetic polypeptide
HVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVCPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCESRG

SEQ ID NO: 3 - protein, 1049 aa, Artificial Sequence
  Description of Artificial Sequence: Synthetic polypeptide
MGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 4 - protein, 798 aa, Artificial Sequence
  Description of Artificial Sequence: Synthetic polypeptide
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 5 - protein, 788 aa, Artificial Sequence
  Description of Artificial Sequence: Synthetic polypeptide
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 6 - protein, 769 aa, Artificial Sequence
  Description of Artificial Sequence: Synthetic polypeptide
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 7 - protein, 1179 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 8 - protein, 1181 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 9 - protein, 1051 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 10 - protein, 1038 aa, Homo sapiens [sequence omitted]

SEQ ID NO: 11 - protein, 1049 aa, Homo sapiens; identical to SEQ ID NO: 3

SEQ ID NO: 12 - protein, 1073 aa, Homo sapiens
MAAAGQLCLLYLSAGLLSRLGAAFNLDTREDNVIRKYGDPGSLFGFSLAMHWQLQPEDKRLLLVGAPRGEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPYLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 13 - protein, 1137 aa, Homo sapiens
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVHARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 14 - protein, 1063 aa, Homo sapiens
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAACFSLRVCASVTGQSIANTIVLMAEVQLDSLKQKGAIKRTLFLDNHQAHRVFPLVIKRQKSHQCQDFIVYLRDETEFRDKLSPINISLNYSLDESTFKEGLEVKPILNYYRENIVSEQAHILVDCGEDNLCVPDLKLSARPDKHQVIIGDENHLMLIINARNEGEGAYEAELFVMIPEEADYVGIERNNKGFRPLSCEYKMENVTRMVVCDLGNPMVSGTNYSLGLRFAVPRLEKTNMSINFDLQIRSSNKDNPDSNFVSLQINITAVAQVEIRGVSHPPQIVLPIHNWEPEEEPHKEEEVGPLVEHIYELHNIGPSTISDTILEVGWPFSARDEFLLYIFHIQTLGPLQCQPNPNINPQDIKPAASPEDTPELSAFLRNSTIPHLVRKRDVHVVEFHRQSPAKILNCTNIECLQISCAVGRLEGGESAVLKVRSRLWAHTFLQRKNDPYALASLVSFEVKKMPYTDQPAKLPEGSIAIKTSVIWATPNVSFSIPLWVIILAILLGLLVLAILTLALWKCGFFDRARPPQEDMTDREQLTNDKTPEA

SEQ ID NO: 15 - protein, 1035 aa, Homo sapiens
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 16 - protein, 1167 aa, Homo sapiens
MELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 17 - protein, 1188 aa, Homo sapiens
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 18 - protein, 1161 aa, Homo sapiens
MTFGTVLLLSVLASYHGFNLDVEEPTIFQEDAGGFGQSVVQFGGSRLVVGAPLEVVAANQTGRLYDCAAATGMCQPIPLHIRPEAVNMSLGLTLAASTNGSRLLACGPTLHRVCGENSYSKGSCLLLGSRWEIIQTVPDATPECPHQEMDIVFLIDGSGSIDQNDFNQMKGFVQAVMGQFEGTDTLFALMQYSNLLKIHFTFTQFRTSPSQQSLVDPIVQLKGLTFTATGILTVVTQLFHHKNGARKSAKKILIVITDGQKYKDPLEYSDVIPQAEKAGIIRYAIGVGHAFQGPTARQELNTISSAPPQDHVFKVDNFAALGSIQKQLQEKIYAVEGTQSRASSSFQHEMSQEGFSTALTMDGLFLGAVGSFSWSGGAFLYPPNMSPTFINMSQENVDMRDSYLGYSTELALWKGVQNLVLGAPRYQHTGKAVIFTQVSRQWRKKAEVTGTQIGSYFGASLCSVDVDSDGSTDLILIGAPHYYEQTRGGQVSVCPLPRGRVQWQCDAVLRGEQGHPWGRFGAALTVLGDVNEDKLIDVAIGAPGEQENRGAVYLFHGASESGISPSHSQRIASSQLSPRLQYFGQALSGGQDLTQDGLMDLAVGARGQVLLLRSLPVLKVGVAMRFSPVEVAKAVYRCWEEKPSALEAGDATVCLTIQKSSLDQLGDIQSSVRFDLALDPGRLTSRAIFNETKNPTLTRRKTLGLGIHCETLKLLLPDCVEDVVSPIILHLNFSLVREPIPSPQNLRPVLAVGSQDLFTASLPFEKNCGQDGLCEGDLGVTLSFSGLQTLTVGSSLELNVIVTVWNAGEDSYGTVVSLYYPAGLSHRRVSGAQKQPHQSALRLACETVPTEDEGLRSSRCSVNHPIFHEGSNGTFIVTFDVSYKATLGDRMLMRASASSENNKASSSKATFQLELPVKYAVYTMISRQEESTKYFNFATSDEKKMKEAEHRYRVNNLSQRDLAISINFWVPVLLNGVAVWDVVMEAPSQSLPCVSERKPPQHSDFLTQISRSPMLDCSIADCLQFRCDVPSFSVQEELDFTLKGNLSFGWVRETLQKKVLVVSVAEITFDTSVYSQLPGQEAFMRAQMEMVLEEDEVYNAIPIIMGSSVGALLLLALITATLYKLGFFKRHYKEMLEDKPEDTATFSGDDFSCVAPNVPLS

SEQ ID NO: 19 - protein, 1179 aa, Homo sapiens
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVVAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 20 - protein, 1086 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 21 - protein, 1152 aa, Homo sapiens
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 22 - protein, 1048 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHIFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 23 - protein, 1039 aa, Homo sapiens
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRGEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 24 - protein, 1169 aa, Homo sapiens
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPTPHYPQDNV

SEQ ID NO: 25 - DNA, 4587 bp, Homo sapiens
gtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctctaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttacgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctcggtagaatccatatacaatatggattgaaaattaagtcacgaagaatacatttagcatctttgtgttgggttctatacctaaaaattttccctcccggcccaaggtgattggaaagtactgcaattgggctaaaattttatctaggatggaaaatcaggatagactcgtttaaaaacaagtatattaaatgggttaaattaagcttttacagaacatgcttaattctgatattgagctctaaatgcaaaacccttttatactgaaaaaacacttaaagcagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaggagttgtctcaactccttggtacagggttcattcaaacccccaagctgtga

SEQ ID NO: 26 - DNA, 105904 bp, Homo sapiens
gggattatccagaattatctcctgtttttctaagtccatatctgtgtaacaccagattaatcaatataatttcaccaaaactacatgccgtaacagattggatgcagaagcagatctgagaatccaaatgtctgtttttaagccagatatttaaaatattagcaaaaatgtaaagcaatgccactcttctcccggattctttcatttggagaaatatagttatttttcataaaatgtacattatttatgttcacacataataggatttttgttaaaggacttactgagtaaagggctcttgagaccaaagagtttgagaagccccagcttaaccttccatatttcctgctctgaatgtggtgtccctcacaactgcaactaggcaggagagcaccctggaaggggttctcaaactactttgtctcaggaacactttatcctcttaaaattaatgtgaggcaggagtttgttctttgtttctaaaagttttgcctggctctggaaaatcgtagctcctgacttattctgcacttcatgacagtgtaatgttaatttgtccagttctgagaacaaaaaccaagaaggatgcatgttatttccccccacccccagagataaaacacaaattcctgtctcacattaaaggaagtgtcctgcctcccaaacacaggtctgttccaaacacttactcacatttcagtgagtcagaaggaaacagacagatattcatctccctgaaacctggctgacttccttcaaaaagtctgtaaggagcgtcaaaatcgtgtcaccggttagtgagcagccacctaagagctctcaggtgatagccggagttttagtaagcaggtgagtaccccagacaattcagaaaaaaatgccttcaggtgtttgtcaaggtgagtaagtgcagccagtaagtgactgataagaaaacaggaaagagcctgggactatataatttgggttcaaagggtattagtcataagccatcagcagcaacatctgatgcataccaatttaatactttaacaatgtgacacatcagccctatctatagtaaagagaagagcttgatttttatgaattattaagtccttcccaccttgagccactttgcttcctagaggcagtatctcaggcatcccattcagctcatagtagcattccatgaagatctggaatgatgacaataatgatgattattagactcataactccttaagcttgatttatgaaaacagttggttccttcacaaaagtagtcactggaagaattctggtttcagcaatgtgctggaaatttgtggccaaacttttggataaaacataagattcagacaagaaaaattaatatcctatttcttaggtttttaactaaaaatctcggatatagaatgttctctttccagatgtgagactgaaataatggaagaaaatggtcacagtctatgtcacggtgtaatgtagacagggagagtcacaagtgcatgtatgggctctcagccttttctctggccttgaagttaatctcctaaactcagtcattaaatcagctcttaattatctcggaggagaggaagtaatgatgatttctctctctctgtctctctgtcacacacacacacacacacacagctcttgcagcaggtattgcttaaatatcaccttggataatcataacttgtgagcagatcttctttcctgatgagttagtttctaacctggtcattctgcgcttatttttgtccctttctccacccacttaggaaaaacagagaaagggacgcaccgcgcagcccctaggcactgtggtttagggctagtgccctcggcacccgctgccaggagccgggcgctgccaagggctgcggaggggccacgttctcccggggactggggcatctcctgcgtgctggcgacagggctgcgggggcggagtggtgccagggcgggcgctcgcccgtcggatatgcccacccgtcccgtccagggcaggaaagcctgccagggcgccatccccatccccaccgcctccaggctgccggggctgggccgctgtacgggagccaaggtgcggtgccccgcgtgtggacgagccgaggtgcagcccgcggggccgcagggccggggtggggcggggcgcggccggagcagatccggtgtttgcggaatcaggaggggcgggccggggcgggccctcggcgctgcaggagctgcccagaaacttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggtaagcggggatttcgctctgcatcggctgcaggagggacccgcgcggcttcctggggctcgctggagggattgggcggaactagggagcgagctccgtgtgttccctcggattccacgtggactcgggctcccagccaccaggacctgcttggaaagagatacttcttcgttcccttcctgctatcccaggccttgcgtccccattaggcgcgtctcgccctgtctgttaagcaccctccaaagtcatctcagtgagtgctttgttttaggtacacacacgcacgcacacacacacacacacacacacacacacagacacgcacgcactcaagcatggacagtgtggggatccgcgggtgtcctggagaccgcgagtcctgcagcccaacttcccctggctcagacaggtgccgcgcctgccagagaccagggaaatccggaatccattgctgatggcggcctgcagctccccagcgcggtgcttgctggctttgcagaagcctgcgagccccaaaatgcttatttttcaacccaaggatgtgaataatgcctctatttcttacttgaggacgaagcgctgtgtttcttcccggggggacttggaataaaccaagcgccacttaaatacttggcagaggggaattcttccttcctttctgccttcctcttattgttgtaacattgtctattcgacgaatgtaaacttaggctaggaaaagttcttttcacttctggatcctagatgccgcaatgagagaataagccggagcagccgctctaactgtagtgctgtggcagtggggcccgcccacctcctgagttcttttacactaagaggaggaaataaggctggggtggagagcttttgtgggaccatcgcctgagtactttttccctgaccattaggcagagctagagtgtggtcaaatttaagaattttagtttatttggagggagaaggagacacgtttgtataatgtagtttgaacagcgatcaaaacaaaacaaaaaagttgtctctgattttaaagtgtgtgtgtggttttttttttttttttacaaagaagataaatatttcctaagctgtcctcctttgagactgacattcagccacttgctattctttattgtggaggaatgaatcctagtccacgtcaacctggtggcattttctccaggtcagagataagagagaaatagcaccactgtccccagcccgagcagagaatgggcatcttaggttttctgtctcacctgtattgggtgcttcagatactttctccgggaaccagatgagttgttttgaggggccaccaaccctaatctacggatttcaggtaaagttgtacttgacattgaaaatgagtctctggaatacaactagagctaatagaaatataaacccaagcttttcatctctctgtaattacccagtattaaaataagctgtggaaacataacatcattttcttatctttgaaatgttgaggcttgttatgtaaagagcagtgagaaattctttaatggaatgtaacgctgcaaggcatgaagtcaggaacagagacttaacctggagttaataaggacacctcagggcaagcaagcagagatgatcgaaaataacatctgcaaaagttttgtgcatttattccctcctcctactccagccatttgtatactcaaggaacaggttttctcttaatttaagatcctcataagaaagctctctcatttgtgatatcacttgaggttcctggagaagcagcatcgttttttggtaccatgagtatcccaggttaacatgaataagtgaaatctctagctcagtagtatctaaaattttgtatggcattaccctatctgtataaaatttctcattcactatcattacacacacacacacacataactgttataaaattatagtatgtacaattgcatcatatcacatacaaaaattcaaatttaaaagctatgtatgtgacagagcttcattatgatgatcttaaattaagagaaaacctgttccttgagtatacaatatgccgtgttatgtatatacaattgtatatacatatatatacctgttaatatgtataaaacacatgtgtgtttagacatcttgtatcatctctagcatacatgcaaaccactttaaaaacatatcaccttcaaatcttattttaacacttacattcaaatttgctttccagaaaccttttcacaggtgcttaagaagaaaatgtactcatagtttagtcctatgtttatcacctttcagtgctcatttctaagtgcttaataccatgaaaatggtaaatgggcagtctgaggatgaaaaagagagaacataagaggcctagataatctataaactaaatataggccattagcagaaggcaaatgtaattttgaaatgaaggccatcacgtattttctccagtatgttcacaggtcaaggatagtccttccacccaggttctagaccacatcttttcttactatccctgaaaccctgccccagcactcatccctcttcagtgcacgtcttcaaattctctccctaatgtaacttcccctcagtctgtaaatattctaatttttcttattgtaaaaaaaatatttcttttgatatttaatttcctcctgaaacatcctgtacttctggcttctgttctcttcctgtttttctcctcctttcctcgctgctctcccgtcatctccttcacaggctctttccttgttggtgtttgcagagtttcatcctgaatcctcctcttcattctgcagattgtctctgggcccattccctgcacaggtccctatctccagccagcctccccttctgagttccagatcagtatttccatcagccaccaaatttctccagctagacagtctgtaagtaagccagattcaacatttccaaaactgaatttaatacgtgtcctccagaattttctcctctattggctaccattgtttaatggcagtattattatcacacaaacatgaaagccaggaatttgtccccatgttttcaacctcacagccactctccaaattctcttggctctcctcccatccatgcaactcctgccacccagtcagtccctcatcttatgtctgtatgtaacttttaaactggattttcttttcttatctctccaacccattctcttcattttcactaatgatatctttctaagacacttatatgtttccaattactgctttgtttcaaatgttagtggctccccatctcaggtagggtaaagtgccaatttcttggcatgtcataaaaaggtacattctacctatccaatcttttctttactgtatgctttcctgaacacaaatacacattcacacacacacaccacacacatgcccacacatgtacacactctaaagccatctatatacaccattctttgttatgactacacctgatcataccatatttagtgtgaaaatattttccaaatactccctttgccttcattgcattgttgctttcaccccttttcactcatctctttgcaactgaccattatccaatgctagaagggtcaatcccaagcaaaattataaagtagagaacttttacttttgcaacaaaaaggaaagcttgaggtaacctacctttgctgggtcccaccctaaaccacctctctggtctcatcctcagccccttaatgggacttaggccgccctctgataaagtaactttgctcccctatggcttagcagttatacctgcccaacctcagctaagctttgctctcttaatactaggtcctgagccactgtttgacttaaatttatggactggggtttaggattcagtatttacaatggctcatatatttctgatgtatggtctggtttggaagtgattgcttaaatatcatcactgcctccccactttcctaagattaaaattccagtgttacctaccccttaccaccttgtgggatgatcaccaagacaggtagatttcaacatcaagagttagcggctgtgagcggctgtgtcagttaaattccttccgaagtggatgatgactactccctgtcttcatgtgctgacagccctggagatattaaaaggtagaagcttgttaatgtaaagagatgagcttctcatgatgtaattttagacattcagcaaaataaagacacatgttcagtcaatgtgtataaagtcaagaatttcaggaagaatggggaaaatatttggggccaaaagtgtccaggcatcacataaattctaccactaaagccataagtcttgactaccaacactgctcagcttgggatattagtaaaagatttagcacagcataaaacaagagaaaccatgaaagatcaccgctctgattggcaagtgaaagaaatggaaggttggtggagttctttttttccagttgttcagtgaccaatcatttaccagcagaacatacagaagagtggctccctacaggggagaatcctagcactgcaaatcatgagacaatagactctgtgtatgacagtgattcctatgccccttcaggtgatccatagaggctttattgatctggctacagtgaatttcataaaactaatacttgataatattcttataaggtatctactttatgtaaggctgtgtgttaggctcaaggtggaatcagagaaaacttaaaacatggctgagagaggttggagtttatttggaaaaaaatccaaacatggggaaaggaaattgtctcagccctgaagcatacttaaccaatttcagccccttgtcatcttcctttctagcagaagtccatttattgagttaccatcctcttctgcatagctaaaaaattgaggtgatgctgaagggtgattaggctggtcccaggcatctgggctgtgtctgatttagccatgggcatgtaatgcaaggttgaccaatgagatctgctgggtgacttatgggaaaagaattttcattcctaagagagatatttgttaaagaaaatattgtcaagtttatatgtgaaatttggaacaactacagccatcttgcaactgcgatgtcaactagcttaaggataaagctagtatattggagttagccttatggaaagaaatggactttgatgttgtctttgaacttctgaattattggaatttaagactatagtatgtcttggtgtctttaaaattttcatataatttaaaacttggttatatcattttctataacttagagagctgtaacatcagtttccatagcataatagatgtcatgtgttcacaattaatgagtggtacagataacatgttgaattcagaggatggagagatatcattgtgatacattgaagtgtctagcctcctgagatgtcttcatggaaacaggtaagaatcattacaatttagatctgccatgaagaacctcagagatcctggagtacagtttctaccttttaaaatggatgtaagtgatactagaaaagcaagcaacataactagcaataggactcatctcctagttcctggggcagatgtttaggttcttgaatagaatactgacgcaatgaaaacagaaggtccttatgcccacaatgtggtattcaagttgttcccagagagtgaaagctgagttgcagccaccagaccttgaagggccttgtaagtcatgatatagagcaggggttttatcctgagaacagtagaaaggtcttgaagggccttgagcaggggagtgacatgatcagatgaggagagtgggttggatggaggccaggtggaaagcaccaagatcatttaagaaagaatatgtttgggttttagttttagtttaggagaccagttgtgagatgatggtggtaaaaactcagatagtggcagagggaagagactggaggatttattggaaaggcattaaagaagaagagtgaacaggatttgatgattgatttactatggaggtggagagagagggagaagataaggctgatgcttaggtttctgacatggacaagtcagttgattttgtgccattcactgagataagcagtgctgaaggagagcaagttggaggaaaaagatgatcagttcaggtcaacagattgagtttgagacatctggatgtacacctggatgtatatgtctaattagcaaatagttatatgtagtggcgttaggaacaggcaggaaagtaagatggggatagagatttaggagtcattggcacctagagaataactgaagataggacattaacaagatgagtcaggcaaagggactagaagagggctttggccatggctcaaggaactgctttagagggtcaggtgaggaagaggaaatgtgaagggagagagtaggaacagctggagaagtagaaagacaactgcaagaactggggtagcacagaactatttggagaaggaagaggtagtgaatagggtcaacttcttcaaagaagtcaagcaagttgatagtcttgaagggcagtctacatggagtgaaaaaagagaaatcagaacagagcggccagaggagtaatggaagatgaggaaatgtagagagtgtgagaaagtttggtatgatagtaaaagggaggagagagtagcaagagaggtaaaatgggagcagctgcctttaagcaaacatgggaaaggcttgcataaaaattattataaggagattttttatttctgttacttatggtgctgcatggtacacttgtaatgttttaaaattgcattgaggtatatgtatgtggcagagattcattgcacaagagaaactgagggaaggggaggagctttgatgactatacaaaggatattatcagagagaaaggagaggaagagagttaggtgtccagcactagtaacagctctggcagaaaggagcccctgcttagaagctgcaggttatcatgggaaggtaggcaaagcagaccctgggctatgaaatagagaggatattaactaatcagggaaaggtgtgaagttgatccaggtatgcaaagagggaaagaaagcagaggtatggaaaaaggtacctcccatcctccagagtggctgcttagattgatgagcccatgtatacattttggtttcaaacatcttttcacactaatgcagttatgattaataagctgtttttagggcatgtaatatataacactccaattccagtggcagaattaatatcagtgcgttagtcagatttcctaaaaaccaaacaagttcttttagaaatatagatttatgtttctccagttaagccttcaattccccttatttctatctagtttaataaagatccccaaaataatcttgttagaaataacagtctcatatatcacagagaaatagtgttgtctctgaaagattttgctagtaaaatgtgaaagctgtttgccctgtaacttagtgttgttttcaaagcatttcaaaacattttcattgaatcataaattagaaaagaagttgatgtctattcttaattttgttagtcataattaaagtgcttatattcaagtgttttatccagtctatgcctgctaactcttgaacacgtaatttacattttagaaccagtataaacttgaactgcatatttggctaatgttttcagctccatagactgttgggacagttaatgattttcaaatatattttacttcctttgagagacttgtctgttctgttgcccaaataggtaacagaaactttgcaattctgtcagcaaagattcctgcattattatcttgttctgaaaaggtgactgaaattcttccatttattaaagtgtctagagacagtttttgctacagaagccatatataactcctgaccactgaaaggctttctgtataaaaatgaagttaatgtttaaacagagcaatggaaataaaagagtgttcaaaaaatggaaataaaacacagcaatggaaataaaagaatcactgtattgtcagtgcaagagattacttcattgtgttttgaaaggcgagcaaagctattgcaccgatggacgccttgaacattggcagttgtcattctcccggattcatttgaaggtggcctttgtttgtctttgtgcaggcctgatctcatttccatggataccatgtagaaatgcagactgaacacaagctggcttcgggtcagttcagtcagacaactctattccaaattgtttaccagttgccttcgagtcctttagccaacagcttcttagatgcttgttagaatagagaccccaaaccatcctggatttcataacctcttctaaaccatattctgaatgctggtgcataaaaatagatatttcaaaataattgacttagtgttctatggtggaggaggggaaggaaaaacttagccttggaaattggggcacttttatgtaatctttattattttttcagtataaaaatttaataaatagccctaatgagaaaatctaatgccacattgaaaaatgattaaaaatttatggaagtagtcatggtaattaagaaatgcctttattattacacagtatttaatttttgcccctcaaataatctgcctttaatatattagtgtcattttattattttttttgctatggttcaagtgagctatcaccttaactctttttaaaagtgaagtcccagaccgagtgcagtggctcatgcctataatcccagcactttgggaggctgaggtcaggagttcaagaccagcttggccaacatggtgaaaccctgtctctactaaaaatacaaaaaaattagccaggtgtggtggcaggttcctgtaatcccagctactcgagaggctgaggcaggagaattgcttgaacctgggaggcggaggttgcagtgagccaagattggtgccactgcacttcagcctaggtgacagagccagacgctgtctcaaaaaagaaacccaaaaaacaaacaaacaaaaaaggcagagtcccatgagctcctgccttttttcatgtcctctctctctttctggaatactctttagccccagcctccattctgtgcatcgtttaaatcttaatttcactgaggttcatgcaccctaggaaccctgccaatcttctaattcaatttaggtatcactcctcacttggacccttccatagcaatgttacattctatttcaataaccctttcagaacttggctatagttcttactgactgcaagctgagaagacaggcccatatcatcttcacttgtatcaagggttcttggcaccattttattcaatgagtgatgaatctatgagccatgtatgacagctactgtaaggggattaaagacacactttctgaatgaaggccaagctgaaaaatttctacttctttccaattagtatatgcaaaaataattctatttgtaagtgtatctgaatttgctaaaatattcctttagttgataaatttgttttcacttctttgacagagtttgtttgcttttaaaatgtttttcctttctcataacatgtctaactaggatagctctgttgacaagtaacaagatgaatgaaagtattaggacagtacagatatcattttttccccaaacccttttctgttccccttttctgttctcataaagcaacaccataatttatcttcagcttgactctctctcccaccgaatacattctttaagattaccttctgtcctatttatcattgtatttcaggagcctggctcatagtaagcactcagaaaatgatgtattaaaaaagaaaaaaaatcaaaattcaaatacagtaaattttaaaacttttatttattgtaaaatgtaacatacatgtagacaaatgcataaaaggtaaatgtacagctttttagggcttgggtttcattttactctacttagaattagtaattttgtttgttactatttcacggatgctgccacaagacatgaaacttctgggtaagagacaaaggtctttattactcattgcacagcaagtaacttgatcagcatatctgtgttgataccctttgcccaccaagacacagaggggcaacacagagggcccagatagatgcctaaacatgcagtaagttgcattacagaaaaggaacactgagcatggtgaatctgctgttttgtagcaagtcagaaagcctgttctttgtcccacagggagatgttacctcattcttcaaagatgctcactgcaaagacatccctgagaaatgctatggtaaacagtcatcagggtcttgcatctcaggcatactcagcagatatgtaggtgtgttagatctccatggaagcatgtctcccaacacagcttaacacataattttttaaaatgttgtgtaagcacaactcagataaaaaaataaaaataaaagatttccaggatcccagaagtcccctatatgttcttttccaatcacaaatccatttctctagtcttatttttttggcaataatttccttgctttcatttatactcctactagttaaatataccatctacactcaagggtttaattttgctagattttaagtatacacacacacaattatacaatacatattattttgtttttgaattttttaacattgcaattgtgagattaatctatatgttgcacatagatatagttcttttgttttcaccactgtacagtaaatagtatagtatttttatcacacagttcttcatcaccagattgctaagagattttttaaagtgacaattgagtattaattttataaatatttttctgcatctattggttattacataaatttttcttctttattaatgtggaaaattacattgattgatattaaaatatgatgaaaacctggtatttgtggtataaacccaagttgatccacatgttctttttataggttgctggattttgtttagaatttttgtattcatgttcatgagtgtgattatcctataattctttatgtttcttactctctctactgtattgtccctccatatgtctgcctacacttcattctggttagtttcttttatcctatattactgtttactaatttttgtttcaacagtgtgtattctggagttaaaacattcattgagttcttaatgatggttattatatttctcagtttatgagtttctatttggttcttttctaaatttctttgctaagatgtttaagtttagcttgtccccttcacaacttttgtaaagttagtgctggttcccatttatgttgctttctttcccctggtgcctgcttatcttagctagacgttatattagaaaaaattatttgaccaaaattgtttgaggcttgggtgatatttttctacataaagcattttcttttttttctttttctttttgtttttttttttttttttttttcttgatgaagtccagctctgttgtccaggctggagtgcagtgatgcaatcttggctcactgcaacttccaactcccgggttcaagcgattctcctgcctcagattcctgagtagctggtaatacaggtgtgtaccaccatgctgggctaatttttgtagttttagtagagatggggcttcaccatgttggccaggctggtctcgaactcctgatctcaagtggtccacccacctcagcctcccaaagtgctggaattacaggtgtgagccaccacacccagcaataaagcattttcatttgcttctattgagacaataccctagaagttttgcagtggcagtgtgatgaccaatgaggtttatctgaggtgcgattattgctaattgaagcagtgccctggaggtactagaattccttatcagtttcatacaatttcagggcttgattttttataggttacccagacaattcattcaagggctgctttacttatggttcacatgtcatgtaaggagcagtggttttgagcataaactctattcctgggatttatcagataccccacttttgacaggtcttggatttcacttttcagatcctttttaggattggcaaatcgctttcttcactgtcctctagcaagacaaaaagtgattcaactccccagcactttggaaagccaaggcagaaggattgtttgaggccaggaatttgaacctagactggtcaatatagcgagactctgtttctacaaaagaaaaatttaaaaaattagccaggaatcgtgctgcatgcctgtagtcccagctacgccggaggatgaggcaagaggatcatttgagcctaagaggtcaaggctgtagcaaacctggatgacagaacaaggccctttctaaaaaaaaaaaaaaaaaaaaaagtgatccaactgtctgcctgagtcatttctctgaacttctttcttcaccccatcttcttagcaatttgatgctttagaagacatcttaaatatcttgttttatatttcttgcaatttttcagtgatcttcagtgggagagttggttaaaataacaaagtcttttattgccaaaggagaaaatctggagtagtgttttagagtccccttttaaaaaaatattgatttttaattttccaaattctcctcatactatttattgatgtggcattttaactgatagaaaattagattttttcaaaatagattaaaacaatattcaatattggttagtattctaaaattttaattttatagtataaaacatttttgaccaataaattcaactcactttttaatatatatctgtatatttgcttgtattaattactcccttttctttaactgtgaagtaaatgtgtccattgaaatactaaacttgattaataattttatcttgtggattttctttataaagttgaatatttaaatatctttagagaaaaatgacacatactaaaataattaacagaaaaaatatttatatttcttttgatatttacatgtgattatatgaatataatcttttcatagatatactcactatatgcaaatgaatactgcacttttatcacttaatatattttgtatatacttttccatgtgagttttatatttataactttaatgcatcctgccatgccatggttaactattgtcccattgttggatatttaggttgtttcctgtgggatattttgccccccactgtaaataatgtggctataaacatcattgtacaagaagttttttcttttcgttttacttttggatcatttccaaaaggggcattactatgtcaaagagtgtgtgtgttttttagctcttgttgcatatggaacagtgtagccatctgtaatgtggaatttaccaatttcatcagcattagattttcatttacttcttgaagtttgatggatataaagtggtgctccatatttatttccattctttttattcatgagggtgcattttttcaagttacgatttaaaaatgcctatcttttgaaaaaaaatatttttagattagggtattctagaaatttgagctagaagaaacctcaagatatcatctagttcagtgtcctgctttattcttatgataaccagccttgaagtgactaaagaccatgactccaacctgaacagaacactccagccagtatagtgtccatcattttaagctacccattggggctccctctcaaaatctctttgacaaactgccctttgtcttttattccccacaggctgattacaatccattttcacttgaggcatggcaatcttctagttaaaatttccacacttccatgggtcagaaccctttaagggagagggaagacattctctctgccagagcacttgactgtgagtaactgaatctgtagactgttctggttaccccttgacatgtaaccagtcaccccaaaatttagtgatatgaaaccacaacctcacttattatctctcatggtgtcttgggtcagggctttgagaatggcttggctggaccatctcactcgaagtctctcacatactgttagagggaggcagctctccctcttcctgtggtatcctcaagcctctccacatggtgccctctgagtaagttgacttcttgcatggtgggtagggcaccaaaggcaaccatcccaaaagaaactggcagaatggatgggcttttataaccttggctcagaaatcacataactgcatctattcatcaaagcaatcacaaagtctcacctagattcagggggaggagacttaagattccacctatggatggggagtgtcaaaagatttccagacatatttttaaacaaagtagtaacttaataaacttaatggtcctcgaccattcattgttttctttttctttttcttttttagagacagagtctcacgacgtttgcccaggctggtcttgaactcctcagctcaagcgatctgccctcctcagcctcccgaagtgctgggattacaaacttttgagagaccatgcgaggccccatttgttgtttagaccagtgtttgggcatggatattattgacaattggggccagataattttttttgaagtagtaaggtaggctgggggtgtctggtctgtgcattgtaggatattgatcatcagccctgtcctccacccactagatgttaatagcaatacactactccagctgccctagagtgacaaccaaaaatatgcccagacattactaaatgtcctctgagggataaaattacatccagttgagcaccactgcactaaatgaacatatattaagcacatttaatgttcatggcaacataaaagagaactccaactctggagagtaagttaaatcccatcatttttctgagtaactttagataagccataggcaaacaattccctaccttgttgggtcattgggaagatcgaaggggattataagtgaaaaagtatttttcatattgtaaaagcatatggaacattatttaaaaaaaaatcagtacacttggtatgcatccatttttatcatcattcatttatttaagggaccttcttaagggacttttatggagtgcctattgtatacccacagagtgtcaggcctggggcactggaggattgaggcagccagcccccttccagaagctcttctttccatttctagcatcacctggacaggagaatagtagcacctagatccttagtgactgtaaagtttgacacttaaagcaaggactttctaagaaaattgcatctttctttttttaataaaagtaaggggaaatgttatgccactgcattccaaaagcagttgtaagggtccttttgtgcttttggtttttgctctaatgttttgtttaaggactagagccataaaccaaacattgcagaacttaaatctttacacagtgtgtggtcatttccaaaaggcctacaacttctaagtttagttgctttgttttttttttttttttttttttttttttggagggggaggagaggactttctacttgcattactgtcctttcaacatgaagacaatgctattggaaaatgagatttcctgtggtgatgtatgtgttcaaaagatctaatgtgacctatgatcatttcccgttgccatacacattctgagtaatgatgagatacactttagagtttgaagtctatttgcttaggttcagagtcagggtctgagtaaccccacttcctgtttgtgtgacttcctggagggtccatggaaggataatattttcttggcttttgtggtgtgcttctcgtgtgtgtcagcaaaatgcagcaacgtgtcatcctcctaaccattagacagcaattttcagaaatgtgaatataaatttgctcaggatatactttttatgttagagatgaaagtgggggccaggtgggcagatcactggaggtgaggagtttgagaccagcctggccaatgtggtgaaaccccatctgtactaaaaatacaaaaattagccaagcattgtagcaggtgcctgtaatcccagctaacaggaggctgaggtaggagaattgctggaacccgggaggtggaggttgcaatgagccaagattgcaccactgcactccagcctgggcaacagagcgagactctgtgtcaaaaaaaaaaaaaaagatgaaagtgggataataaattgctatgccttattaaatttctcaagaagtgtgcccccctcagtagtgtataatgatactaatcgtaaaaacaaaaaaaatctactaagtacttaccatttgttagacactgggttgagagttttatatgcattgtctgaccacaatgaggtaaacatatacatgatatctattttacagatgggaaaggaatggcttatacaaaacaaggaacttgctcaaggtcacagtactattcaaacctcagaggccaagctcttaggcactgcgatatactactggctttgctcagtaaatggacctttcagcttaaaaaatgctgtacatcacaaactaacacagaaacagaaaaccaaacacagcatgttctcactcgtaagtggaagctgaacaatgacaagacatggaccccgggaggggaacaacacacactggggcctgtcggtgggggcgaggggagagagagcatcaggataagtagctaatgcatgctgggcttaatacctaggtgatggattgataggtgcagcaaaccaccatggcacacgtttacctatggaacacaaacctgcacattctgcacatgtatcccagaacttaaaataaaaagttacagttgtgaaattttttaaaaatggtgtacatctcttaatggtattagcatacttctgccatgccatcaccccgtaatatagtcagtcttctttttagggttctcctatagctagattcttgaaaaagttaaatgttctgtcaaattctaaatagaaaatacaatgtgtttatttgcatgaacatatgtgtatataggtatgtatattttaaattaatctgtcttttaattcattgatgtatatacctgcacagtagcctgcattcaagaggatttattagttaattaaactgttctttattaatctcctattatatccgtaacttattgttaggtggaaaggtgaagcaatcagtgtttattcagtaattattattgaaccacgaccatgtgcaaggtattattctaagtgctggggaatatatcagtgaacaaaatagacacagcccctctctgttagggtcaaaggcatatttattataaaacaagtgaagccgaagtttcaggggccctccctgtgcacttcccttcctctgttttcacagtgccagatattttcattcaacatgcaaaaggttaaggtcaccgtctcttttctatcctaacacaacatatttcaacaacaaaaacataaaaaaaaattcattaatcaacttcatcaattcagaggttctggattaatcactataaaacaaagcatgaggtgccttgaaatgctgtagctcctatgcagacttagaaaacagtcctaaacatgtgcatggcatcacaaacagggaggtgtgaaagtgaaaggagcttttcctaactacgaataatgataattttaaaaattcaatgtagcatgctagaagaaaaaatgaattctcttgttctctttagagaataggacttaataaaattgctgtcatgtgaagaggtgatatagagcagagccccaaactaggaaaaaacgagttgcataagtgtgtcaggcaatcagttggatttccaggaagtacactacagtaagagctgccaatagtgagcatcaaagaagttggaagaaaggtatgcacaggctaggatggtcagaaaagaccctaaccaaaatttatagagaagtggcttgtgaacagggtataataaaagaaatactaacttcagttatgtctgttttttccatatattgcctcaagatatgtgagacatatcctgctaatgagcaagttaggtgacaggcactgacttgctaaatacacacaaaatatgctattttgagagagagaaacggggagagagagagaaaaaaaaaagagaaagtttatcctttcacatagaagcaatttaggaagaagtggagaagtagaaagtgacttcatgagatggtatttctagtaactcttgggccaacacactttcttctgtatttcactgtcttcctctcagccactgagagacggcaagtctaccagatggtggcttaccctccagcaatcttatgaaaaagagagaatctattgagttgttaagaagcactaagtcataataaatggacattagaggcaattgcaatgggcttttggagatgttcctggcctgaagattgaatttttgaaatgtgaaagggcctccaaatgatctaaacacatgccacagtactccaggacttgatgcagttacaaaacaaaatgaaaacaactttggattgttttcacacaaaatataaaccttaaatgatacaactggaattattgtatatctgtccttatatttatatctgtgcataaatgtatggacagaattatcttcaaaacctgaaatagtaaattggaattttctggtgtaatatactttctccttgtattagtcagctcgggttatcataacaaaatatcacagactaggtggcttaaacaagagagacatattttctcacagttctggaggttaaaagttcaagatcaaggctctctcaggttggtgttggtttctactgaggactctcatcccggcttatagatgggcactttctcaccatgtcctcacatcacctttccctatgtgggtactgagagagaaagatctctggtgtctcttcttcttgtagggacatcagtcatactagattagggcttcactcttaggacctcatttgaccttaaccacttcattaaaggctctgtctccaaatacaatcacattgagggttagggtttgaatacaggaattttgagagacacaattcagtttgtaacaccccctttggcttaatggtttaaggggtttatttctggtcatggaagtgacgctcatgtatttctttgatatgaacacaaagtaagtgtcaaacatatgatatatggacacactgtaaaaaacaaatagccgcaaatcatgaagcaggatattatcgccagatgtcagctagagtctctctctctctgcctcttaaaattgagataagatttattcaaatccctattccattcttataagaaaatgcagtgccctctcaagatttccgtgaactcccaggagatgtgcattttcattgacttgggccctcacttcctgactgcagagtgtttattctccactctgccaggtctggtatttgattttgaccctaggtacagtcaatacattagcctgatactgtctcatggatgctacaagatgccatgacatgcatgagtcagagaaggactttattactcacagcacagcaggcagcacgagtatgagcatgtgtctatcagttcccctttccccactctagtctcatagtgttacatgaaggggcccagacagacacctgcacacagtggggtgcaagacaggaaagaaacaatgagcttggtggacctgctgctttatagcaagcagtcagcaagccttctctttgacctgggggaagagattatctcacccctcaatattattcatcataaacacaatgctaagaaatggcccaggtaaatagtagtcagggccttgcattcttgatatacccattgtattaagttgaatggtagtctcccccaaatatgtctctattctaatccccaacacctatgagtattaccttatctggaaagagggtttctgtagattgccttgaggagactgatggtaaaaacatgaaggctcaagctacttctggtgagggctcagaaggaaaccaggaatatgctgttggaaactgcagaaaatgtcctcattatacagcggcagaatatttgacctaattgggtcttattgttgttcagaaagcatacaacttttaagtgaggaacttggatatttagctgagcaaattttcaagcaaaatattcaaggtgtagcctgtttttacctgctagatatagtaaattgtgagaggaaagagataatttgaaggatcaccacttgatgatctggcaaattctcagcctatctagattgattatatattttatatatatatgctgagtgttatggactgaatgtttgtgtctctccaaaatgcatgtgttgaaatgcaatccccagtgtgatggcatttggagattgagtctttggaacataattaggtcatgtggatagagctgtcttcctgccttgtgaggatgcaacaagaagtcagcagcctgaaacttggaagaaggctctcaccagaacttgaccatgctgcacaatgattttagacttccatctccagaactgttaagaaataaacttctgttgttggccacccagtctatggtactttgttataacaggcggaatgaagacactcatattaggagtttcactgttagaaaagcatcctctgaaagcaaagggtgtggctagacatccttttgtggaaaagattaggtatgtggttgccagatcctctcaaccatctcagcaacaatcaaaatagtgatgaggttatccaggaaagatttcctgtggagagctcttttgtttagtggcatgaatcctgcattacctacataagaaacctgcaaatttttaaaaaaatgttatctcagcagaagcattgccatctttgactgaaggtgatagagaggcagaggccagaggagctgttgagagcccagaggcctatggttgacagcccagagaacagaggctcgaacaacagaggattattctcaggccttgaaatctaattgaaaatttcctgctaggtattaaatttgtttaaggttggtgacccttttactccttccaattgctgccttttgaaatgggagtgtctatcagatgcctgccccaccattatattttggaagcaaataacctattttctaggctcacaggcttagagatggagaggaattttgccccaggacagatcatgcctggcatctcactcacaccaaatttagatgatgagatttgggacttttgagctgacaatatttagatgagatttcgagctcagagttaattctgtaatgggttgagccatttggaaatgttgagataccttaaagaatgtattttgcatgtggcatgaatgtgaattttggggggccaggtgacagagtatagtgactcccaaaaagatatgtccatgtcttaatcactggaaccagtaattggaaaaggggtctttacagatgtggtggttaaggatcttgagatgaaaacatcctggattatctgggtgagagctaaatccaatgacaaatgtttttgtaagagtggggcagagggagatttgacacatgtaaaggggaggaggagatgtgaccacagacatagagattggagtgatgcagacacaagttaaggaatgctcacagccccaagaagatagaagaaacaagaaatggattcttctctggagcctgcagagggagcagagccctgccaacaccttgattttggacttctgaccttcagaactgtgagagaataaacttctgctgttttaaaccacaacgtttatggtaatttgttacagcagccagagaaaactaatgtatccattaagacatatagaggggccagagacccatagaggactgtctttcccagctgactaatcctgtagttgttcctttattttgcctaaaaggttgaattttcttccttaactttcccacaaaatcattcatacaatacctttgtgtgtgcaatgagcttttgccaaggtgtggtgagatcagaggcaagccaattacagcaatacaaacagactaaagtactgttaggcatccctgttgctgcaggtttccaacccaccgctatgttgctggtcatcctttctttccctcttgtcattgttcctgcctccctcaaagtcctattcagcttcctccttagtggccctgcctctttattactgatgccctgaaagttttatctgcacctcagtttatcaaggatttttctacacaaagatagtttctctctaaaatataagtataaaatattttccccattaaataataaatgattgcatcagagtaatagtgtttaaaaagaactttgagagattcattgtagtgatggtgaatatgtgagtgggggggagtgaggggagtggtaataaggaaggaaggtaggatgggaccaagaaaacccggactcagaaggatgttggaattagaaccagtcagagctagagaagcaaggtcctcaaggctgagaatatgttctcatgcatccagacatcaaagttacaaagtggaagaatttgccaacttaaaatgtaagtaatgagtgtatttgaaaacaaatttgtcatcactgattttagcaaaatctgtgtaaattaagtacaaagaaattgtcatggttataaaaaaaatccttgggagcagtaaagggttatttatatgtaaaatatcattatagtcttaggaagttgagcacagcctggctttcattctgcaccacagactagagtggagattccctcaggatgaggactgtattttaaatttcattgatgattaacactttctacagggtgggaaaatattctcctactgtacactcttgctgagaatttgtaaggtttgtggatgcatttggatttatttggataaaaaaggatgagtttgttcctaatacacatgagatagatttggttttctgttcctggcaccagatagcaacattatatccaaatggtggcttggattgactggaaagtttcaaataacattaaaaaaattaatttctatttttatttttggagaaggaagaaatgattctgtcttaagcatcagcatttattgctttctattatttttatttttaaacaataccattgttgggctacctttggtgggcatttaggttgactccatgtctttgctattgtgaacagcactgcaatgaacataggcatgcatgtgtctttatggtaaaacaatttatagtcctttgggtgtatacctaataatgggattgctgggtcaaatgataattgtgttttaagttctttgagaagtcaccaaactgctttccacaatggtagaactaatttacgttcccaccagcagtttataagtgatcccttttctctacaacctcaccagcatgttatttttttactttttattaatagccttgctgactggtatgagatgatatctcactgtggctttgacttgtatttctctaaagatcaatggtgtggagcattttttcatatacttgttggccacatgtatttcttcttttgaaagcattggttaatttcctttgcccactttttaatggggttgtttggttttttgctggtaaatttgcttaagttccataccgattctggacatttaatctttttcagatgcatagttttcgaatattctctcccactccataggttgtctgtttactctgttgatagtttattttgctgtacagaagctttttagtttaattaggtctcacttgtcaattttgttttgttataactgcttttggcatctttatcatgaaatccttgccagagccaatgtttggaatggtatttccttgattattttccaggttttatactttcaggttttgcatttaagtccttaaatctatcttgagttgatttttgtgtatggtgtaaggaaggggtccattatcaatcttctgcctgtgactagccagttatcccaacaccatttagtaaatgggcagtcctttccctatttctttcttttttttttttttgtcaactttgtcgaagatcagatggttgtcagtgtaaaactttatttctggggctctctattctgtgccattcatctatgtgtccatttttgtaccagtaccatgttgttttcattactgtagccttgtagtatagtttgaagttggataatatgatgcctctaactttcttctctttgcttagattgtttttgctatttaggctctttttgattccatatgaattagaattagttttttctaattctgtgaagaatgtcattaatagtttgataggaatagcattgaatctataaattggattgggaagtatggccattttaacaatattgattcttcctagccacaagcatgaaatgtttttccatttgtttgtatcatctaggatttatttcagaagtgttttatcagtctctgtagagatctttcacttccctggttatctgtactcctaggtattttattctttttgtggcttttgtgaatgggattattttcttgttttggccctcagcttggacgttattggtgtataggaatgctactgatttttgtatgtcaatcttgtatcctgaaactttgttgaagttgcttatcaaatctaggagctttgagcagagactatggcattttctaggtatagaatcatatcatctgcaaacaaatagtttgacttcctctttttctatttggatgcctttatttctttctcttgtttgattgctttggctgtgactaccagtaatatgataaataggactggtgagggtcagcatcctcgtcttgttctggttctctaagggaatgcttcccacttttgcccattcagtatgatgttggctgtgggtttgtcatagatggttcttattactttgaggtatgtttcttcagtgcctaatttgttgagggtatttaacttgaaaggatgttgaattttatcgaaaggtttttctgcatctattcagatgatcatgtggtttttgtttttagttctgtttatgtgatgaatcacatttattgattggcatttgttgcaccaacttgcatccgagggataaaacctacttgatcatggtggattagctttttgatgtgctgctggatttggcttactggtactttattgaggaattttgcatctatgttcatcagggatgttggcctgaagttttcttttttattgtgtctctaccaggatttggtattagaataatgctggcttcatagaatgagttaggaaggagtccctcctcctcaattttttggaataattttagtaggaatggtaccagctcttctttatacatctggtaaaattcagctatgaattcgtctggtcctgggctttttctggttggtaagctttttattactcattcaatttcaaaatgcattattggtttatccagtttcagtttctttgtggttcaatattcagaggttgtatgtttccaggaatttatctatttcttctaggttttctaatttgtgtgcatagaggtgttcataatggactctaagggtttttagtatttctatgaggttgctgacaatatcccctttgtcatttctgattgtgtctattttaattgcctctctttttctttattagtctagctagcagtctatctatcttgtctattcttcaaaaaaaaagaactcctgaatttgttgatcttttttatgggtttttgtacctcaatttcattcagttcttctctgattttggttatatgttgctttctgctagctttggagttggtttgttcttgttgttctagctcccattggtgtgatattaggttgttaatttgagatctttctaactttttcatgtgtatgtttagcactatcaactttcctcttaacattgcttttgctgtgtcccagagattctcatgttgtatctttgctttcattagtttcaaagaatttcttgacttctgccttaatttcgttgtttacccaaaagtcattcaggagcaagatgtttactttagatgcaattatttggttttgagcaatcttctcagtattgatttctatttttattgtgctgtggtccaagactgtggttggtatgattttttttttaaatttgctgagaattgttttatggctgattgtgtggtcagtgttagagtatgtaccttgtgcagatgagaagaatgtgtattctattgttttggtgtagaaagttcttagatgtctattaggtccatttgatcaagtgtcaatcaggtcctaaatatctttgttagttttctgcctcaatgatctgtctaatactgtcagtggggtgttgaagttgcccattattattgtgtggttatctaagtctttgtaggtctctaaggacttgttttatgaatctgggtgcccctattttgggtgcatacgtatttagggtagttaggtcttctgttgaattgaactctttacatgatataatgcccttctttgtcctttctgattgttgttggtttaaagtcaattttgtctgaaattagaatagcagcctctgcttttttcacttctctgtttgcttgatagatttttctccaactctttgcctttgagcctatgggtgtcatcacatgtgagaaggttctcttgaagacagcatacactcgggtcttgcttctttctccaacttgccactctgtgccttttaattagggcattcaggccatttatactcaaggttaacattgatttgtgcggatttgatcctatcatcaagttagctgattgttatacagacttgattgtgtagttgctttatagtgtcaatggtctatgtacttaagtgtgtttttgtggtagctgctaacagtctttcctttccatatctagcacccccttaaggacctcctgtaagggagaggtctggtggtaactaattcccttagcatttgcttatctgaaaagatcttatttctccttcacttatgaagcttaatttggctggaaatgaaattcttggttggaattgcttttgcttaagaattctgaatataggcctcaaatctcttctggcttgtagtatttctgcttataaggttcgttgttagcctgatggggttccctttataggtgacctagcccttctttctggctgcctttaacatttgttctctattttcgactttggagaatccgatgactatgtgttttggggatgatcatcttgtctggtatcctgcaggggttctctgcatttcccgaatttaaatgttggcgtctgcaatgaggttggggaaattttcacggatgatatcctcaaatatgttttccaagttgctttctttctttccctttctttcagggataccaatgaatcataaatttggtctctttacataatcccatatttcttggaggttttgttcattcttttttattcttttttctttatttttgactgagttaatttggagaactggtctttgagctctgacattttttcatcagcttggtctattctgctgttaatacttgtgattgtattatgaaattcttgaagtgagtatttcagctgtatcagatgaatatttctttcttgaaatagtcattttgtctttcagctcctgtattattttgttgtattcctgagattccttggattgggttttgactttttctcctgaaccttgatgatcttcatttctattcatattgtgaattctagttctgtcatttcagccacttcagcctgggtaagaaccattgctggggaactagtgctgttgtttggaagtaaggagacattctggctttatgagttgtcagagttcatgggctgtttctttgtcatccgtgtgggctgatattccttcagtctttgaaattgctactttttggatgggttgttttttgcttttatcttctttgatgcacttggaggatgtgattgtggtgtttagtgaactggcattgtctctgtaagattatagggagcaaaggctcagccctgcactcctaggcttcatactctaactctgaggaactggcattgggcccccccgctttgttctctggtctttcaaggttaggcatctgctgcactggaggggccaaagtgttcatgctctatattgtccacaacactccgatgggggaatgccagccaaagctctttgttggggtggtggcagcaggatccatcgtcacttttatgtgacagcagctgtggcagcatggccgtgtgcccatgtgtcagctggggtggggctccagaaggagcagggtggcagcaacctgctggcggtgcatggtagcagtacagcaggggcagggcaccagtggggatgaggttgccagtattcctgtgtgcattcatgccagcatagcaggctgcccacacatcagctgggggtatggtaggatgagcatgcactggcaggggaggagagacaaggtcttctggcatgtgtgggccagcaaagcagtgttggggggatgtggaggggtgtgaggcatgggtaagcgcatgctggcaaaatgctggggagaggctgcggttggggaggctgtggctgggggaggctgcaggtaaaccattatgcatcggtaggggctgttctgctggagccctctgatggccaggcatggtctgtcagtgcaggagctctgatgaggtgccctaggaagcactctggttgggcatctgaagctgctctgcaagaggccatggtcaggctggagctccaggaaaggccagcagacaggagatgctcagataggactggccccatcccacgggcaagactgccctgctctgtccgggtccaacagtcaccctaaggctaaagtctcctataggagcacggcaggccttgagggatgggcgttcttggccatattctgctgttgttaaatcctctgggctccccactggctggagtctgcctttgccacctctctaagcagctgtctttgtgtcagctcaggtgtccgtgggggtcgtgagttccgctgctaggatgctggaggtccatggcaggagcaggccactcctcacctgttcaactgaccccagaagttgctggggaccaggaaggattcctggtgctgggcagcctcgtgtagggctcctagctttctcccccttcagcccagcatccgtgtcctccctcatccactctcaatgccttccctgcaaagacctgttcagagtgtgtgccagccttcccaatgtcctggtttctcggtcggagaggtttcttcgggctgcctctagtcagccatcttggctcccgtcttggtatagtttttgagtacacaaagaggattatagaaagcatataaaatatttgtagaaattacatttattcttgaagaggtcatgtctaaaattagtgaaatactctttaaaacattttgttttttaggctgggcacggtggctcacgcctgtaaattccagcactttgggaggccgaggcacgtgggtctcctgaggtcaggaattcgagaccagcttgaccaatatgatgaaaccctatctctactaaaaatacaaaaattagcagggcgtggtggtacacgcctgtaatcccagctactcaggaggctgagatatgagaattgcttgaacccgggaggcggaggttgcagtgagcggagatcgtgccattgctctccagcctgggtaacagagcgagactccagtctcaaaataaataaataaataaataaataaataaacgtcaaataaataaataaaacattttgttttttaaatgaaaataaagggtactttaaaaaaataattttaaaataagttgaattatttaaaaatgattcaatgatttattgaaccacaaaggataaaagaagtaattcatataaataagcaaactcattaattttttatcttgagcaaaatatataaattagttacccacggtcacctgtgacctaaaaatattaaatggaaaatttcaaaagtaaataagtcataagtttaaaattgtgtatcgttccgagtagtgtgacaaaatctcactccatcctgcccaggatgtgaatcgtccctttgtccagcaggctgtctgaggcccctgcccattagtcatgtaggagccatcttggttatcagatcaacagtcatggtattgcagggcttgtgtctgagtcacccttatttatttatttagagatggaatcttgctctgtggtccaggctgcagtgcagtggcatgatctcggctcactccaacttccacctcctgggttcaagcaattctcctgcctcaccctgccatgtagctgggagtacaggcatgtgccaccatgcccagctattttttgtatttttagtagagatgtggtttccccatcttggccaggctggtcttgaactccttacctcaggtgatctgtccacctcggcctcccaaagtactgggattacaggcgtgagccaccatgcctggccaagtcatccttattttacttcataatggccccaaagtgcaagagtagtaatgctggcatattattataattgttctgttttattattagttgttgtttttaatctcttgttgtgtctaattttataagttagatgttattataggtatgtatatatagaaaaaacagtatataccatatagggtttggtattacctattgttttaggcatctactggagggatgggaggatcttagaacacattccctgaggataagagagaattaatgtaattctcattcctgcactaagaacaatgtttaccacatcataaatactcaataagtttattgagtgaacaaaaaataaataggaaaataaaatctgtttattaactgtgtgtataaattcattagttttgtattatggacagttttgaatagagagagaaaaaacatagaatcatggagaaaatatcacaagttatcatacagatatgaacaagtttatacaagacttattacaaacatagagttccatggaattgaagtgttattatgtgaccatttgagttactgagatgaaagacatttataaccattgcacttttaagtctataggcataaatgtagggatcccattcttaggacatgcctagcaaatgaaagtaagagtcaaatgcaacccaatgggccagagtttcctttatatattgtaaattatatatttgtgcatgtgacaataagattacacactgcaaatgatgttgaaataaaatagctcatgcttatagtccttctagtccagggtaggagaagcaattttctttcttcattattttatcctgattcttatttttattttattttattattattattattttttttttggtgaggtggagtttcactctgtcacccaggctggagtgcagtggctcgatcttggctcactgcaacctccgccttccgggctcaagtgattaacctgcctcagcctcccgagtagctgggactacaggtatgtgccaccatgtccggctaattttttttttttttttttgtatttttagtagagacggggtttcactatgttggccaggctggtctcaaacttctgacctcaggtgatccacccaccttggcctcccaaagtggtgggattataggcatgagccaccgtgccggcctttttatcttgattcttatacactaaaggaaaatttaaaagcagctacattacactcacaattgtactgtttgttgtgttactattcacatatattttacctttttcttctattctgaatattatttttgttattttattttcgttaagcactgtcatcttcttcacaattgctgtttttttaatggcaggataaaactctgtctagtttatatgctaccatttgcatattcacgcccctaatcttggacattcagataattttaatggtggttattaagaactaatttttttagattgctagaaattattaaagctatttaatatgtataaagtgtgttttcttaggccacctaagactgagagatgacataaaatacaaaatttttattagcaaaatagaatttctgtggcccagccacctacttacacacacagagagcctaagtgcctaaacactgttttctcattcttccggagtagataacattctcccagactctagagcatggttctcctggaaacctttgctgcccctaattgtgtcccctgtgtcctgatcactattgcaccacggcccctgccctcggcatgctctagttgctcactatcctctgccctcttccctgtcaatccttctgcagctactgaggaccagtccctcaggcatgggagaaatgtgctccaccttcttaaagtaatgacactctgtgctcacagttagagataggccttacagttcttatgtttttgttcaatatttaatggagacattgttccccctagaagtgcagtatgcatcttcaggaatgggccaaattgcaatctgagaggctgtgtcaaaaccacacctctattcccaagtccacctcttgcttttggcctttgctctcttctcttaacctgaatttcttcctatgtatgtccctgggcacgttttgcaaatgagtcccttctatgaaaaacccatccctgcccctggcccttcagtatatatagatatgctcaaatttgcattgaccacaaaagttagacccttttattttgccaccctttactacaaaatgcatcctttagttctgacactgatatcatagacatcaataaacttcccttgccaaatttttgtggttgaatataaaatgacatgttttgttttatacattatttacgctcttgttgttaaaagactttttcctttctgagtttcactgcattttttttttttgggggacagggtcttactttgttgcccaggctgaagtacagtggcacaatcacagttcactgcagccttgaactcctgggctcaaatgatcctcctgtcttagacggccattgagattacacgtgtgagctgccatgctcaggctttgctacatttttagaacaaaagtaggttaactatatcaaatccccaatcatatgtttctcttttgaattataacttaaaattatgctccagaagaaagtaggagaataaatttcatatttactaaaattaattcttaaattattgtttccaaaaaaattatttcagagatggtcaggaatcctcaggaaaggagatcctgtaaatttttgtttgtttgatttagagacagagtctctgtcacccagtctgcagtgcagtggtgccatcatggctcactgcagcctggacctcctgaactcaagcaatactctcatctcagcctcccaagtagctggaactacaggcatgcaccaccatgcccacctaattgtctattttttgtagagatgaggtctcattgtgctgccaaggacggtcttgcactcctggattcaagctatcctcctgcctcagactctaagaaaaataagaaatctacatgagttaacttatgcttgactatctggtttacttatggatattaaaatggcaaccagcctgttataatctaggatgaaacagtatcccctttttatttgtgaaaatagaggaaactagttagccctgcatgagataaaatgtatttggtgtaagctttcgtgagatttactggaatactttggcctggttactgtcaacacgtgtctgacaaggtcacctttgttaaatatgttgagtttgcgatgctattattgcctttccaggcattcacatgaggacaaagaaggaagatttatactctgggtgataataggctcctggcaaagcccaagtcagttgaagactcactgcatctaatagagaactggaaatgtatagattaatgaagcaacctatgactttctgtgccagacttttcaccattgccgtactcttctctttcacaccctatgcctacgtttaacatgatgttcccggtgcctgggatgaactttgccttcctctttatgtagtgaattccaacttgtcctccaagatccagattaattgccatctcctctgtgaaacctttgaacttagatttaccctcttctcaatactgagctcaaggttctttttaccactctttattttaacacttatacattttgatgccattttttttagtaaaattaccataatggaaatgcaaagagaacagggagattttagttttatttatttgcagtatcctcaggaccttaaaaaacgcctggtacaaaggagctgtataaacatatgttgaatgatccattttttaagtatgtatagacacatgggcatggtttggaggaaggaaacaagatgaaccaaatatggttcttattatccatatgattcagttgaactatgaggacagacatcagaagatataggcactgggattgcaaagaagaaatacatgttgaattagacagaatacttccattaattttttatgagctatttagatatcatatgccaagtgtgaaatgatgacagagatctgaattgtaaatacatattaagagaaaaagtatagagaattgagattgtccagatttatcaaaagaggcaggatataaagggaaagatttaagtagctgaaaagagatttagtatcaatggaatgaagggatggtgataaagaaggtcatgctttgtgaggaaaaatgagcagatcatttatgaatagaaattctggacaataaagttgagagatgagccaaacctagactcagagtgggtgacattgcgcaagaaagacatttagccttcatgagtttcagtttccttatttgtaatttgttaataatagcttggttttgctgttccacaggattgttgtggcactcaaatgagtcaggatgattctgacataggcagacataagcattaagaaacagtaagatgcgagttggaataaacattataatttaaatagaggaaaaatactggaaggaaatacatctgaattaactgaacttacagtagaaagaaaagattatgaatgatttttcccttgagttttctctatattccaaatcattattgaagaacatatagtaattaaaatgcattttattaaaaaaaaatcctaggtgctgagaaagtaagagtgaataaaagaaacaaggtttgacttctcaaggagcttacattttagtaggcacagacaaaagaatatggctatataagataattttggataattgctctagtagtgatacagtgatgaagaagggtgctgctgctacacagagggccaagggagagcagagacctatttgagcaaagtcctacatgccgtattaggtgaggatgttataggcagtggaacaggcagctgcaaagcgcataagcagaatgagctgcatgtgttcaaaaaacagaaggaaagtgagtgtggctggaacacagggagggaggacgagagtggtcggaagtgaagtcagaaagatacaccagggctcaatcatgaaggacctttgaatttacagtgaggacattggattttattctcagttcaatggcaagacataagttaataatatatatctatgcatatatagtaacacatatatgcctatatatgtgaattgctgtataattgaactgctaaatgataaaatgaactccatcataatttcctgccattaaatgatctgcccaggtctaattaatgggggaaaatgaggtcgttttatgtacagtcacgtgtcctttccagaattaggtattttaaaagtgaaagcagtttggcatcatctctccacgctaatatgttagatgattgataacatattcaaatagcatttattgagctctccacaatggggtgaagataaatgttggttgaaaacaccaggtattttgcatgccaattctggatctctgcttaatttgctgttattttcttttgcatttttttattattcaaaaataaaaaggagcaatggagcatatgaaaaatagatgttaaggagaaaatttgcagatgttaagctttgcagattttgctatagagtatttcagaatgagtatttgtgtttctcttcatggcagcacattatttgtaagaaataaaaagctgaattccttgtgtggacaaatccctgatacagtgattttggcacttacagagggacgttaactacttaaagtccccgttgcttcatcattgacttcattatcattttggagcactctacagaatctgctccctgaaatgcagaggctcaatggaagagcaagcctttttcttccggcctttcagtgcctaaaacaatagacatatgaaataccatgcacttgcaatgctgcctagaaagtaggacatttctttgtgaaagcacatgttaatggaactttgatgtcaattttaaagagtccattctgtcttcagtgtctgcgaaggtaaatattgatcttaagcaacatgaggcatattcccatctccagagagagcattaatatccacacaaccttctttctgtaggatgaagaactggcagcattaatgctgtcagtgtcatacagagaaacatgatttgccttattcctttccttcattccctttccatcagaaataagaattttcaaaaaaaataaaataaaatctatcaaggctttatatgccttggtctttgttctgttttttgaaatgattagcatttctcaatcattcagaaagaagcatcaaaaacaaaacacttttgacagttcccactggaataaaaaagatatgacaccaatccctacattttcatcctcaaaaatgataatgatcacttctgaaagaaaatgataacaattttcaaggagctgtgattttctatctcctttgatgtagtcatcaatgccttttcgacagatgtttcatatagagtccatgtcaagatgttcaaggtgattcagaataaatagatgatacccttcagcccttgcccttgggtggcttagagtcttgttgttttgggaaggacaaatataactcaaattacttaagaatacttagagataatttagttgttttaagtcttgtgttcaaattttgtcttcatcctttcctctttccagctgtgagatatacttgtcccctggaacctcaaaattctctgcaaaacaaagataatattagtaactatcttctagcatttccatgaagattagtaagataatgaattatgcatatatagtatttagcttggtgccgggcctccaaataagtacttaaaaagcagtagttattttttctgggtaaacgttgataagtaataattattaggtcaagcaagttttcttaaaaatggcctttgagaattatacgacacacttatattcatgaattgtaaatatgtgctatttcatatttttcttaataggcattttaaattgttgtttggcctacaatgttggtctcccagaagcaaaaatattttccggtccttcaagtgaacagtttggctatgcagtgcagcagtttataaatccaaaaggcaactggtaagaatattctcttctttatgatttcagtaaaaatacaaaataaatttcatatttgacttcaattgctttttcaaattggtgcctgactgtactataaatgggtggccctcaaatatccttaaatgaacaatctttctttgagagttgacaactgcagactgatcattaatgggatggtataatggttcatttttaaaaacctggatagaaagttttctctaaatattcaaaagcaaatttataataccagttttgaccattaatacataggtaggtagattgatagatagaatgatagatttgtcttcatttctgatcatgtaaactgatattcattgaactttgtaaatcattacctagttattaatgctatctctggaccatttctaaatggtagaattgtttcctacatttttttctttagcaaggttttgtctacttgcttcattctaagttaggcttttgccctccttgtggtgaagggtcctcacaaatatcaatgcaaaatgtacaaaggtggctttctctagcatattaacaccttttgtttttgccccaaagtgctcccagtttttacatgctatgtgatggttacattttcaaaccatggcttttctacccaggtgaaaaacaaccacctcaatggagatggaaatctagttcccataatactaatgcaagtgaacccagagaaatgaggtaatttgaaagttgtatttgggaagaagcgctgtagctcctattctgccagagttcatgcccactggtggacacaggtcctgccatggggaccttatctccttgttgcagcaggaggctccaaccatccccactcaccctggaacttcagattctgaatctccactctctagagctcttttcagtgattaaatgggctgttgttggcttatcaaataagaaccgtaatgtatggccaagtgcagtggctcacgcttgtaatcccagcactttgggaggctgaggtgggaggatcacttgagcctaagagttagagaccacctgggcaacacagtgagacctcatctctattaaaaacctgaaaatcagctggatatggaggtgcatgcctgcagtcccagctactcaggaagccgagctgggaggttggcttgagcccaggagtttgaggctgcagtgacctatgttggcaccgctgcactccagcctgagtgactgagtaagatcctgtctcaaaaaaaaaagaggaaaaaaccgtaactgtaattcataagcctttttttctgtgtgaacttccatttgatactctaaacaattgaattcaaagaaaggttcaggatcacatgttggggcatgcctgtctatttgatgaggaaacaaaatgaaatcatcccctgagagggcagcatttctcagcaggcatcttggaggatgtaaatcgtgagctgggttttaagtagtgaggatgaagaggctggagatgagtgttaactaatgtgaggagacttagaaaacaatgcatgtagatacagtttgtcaattgtctagaaggataagaacatctggttggaaaccaaagattggcaattattgtaaccatttgggatacgagagagagttgcatgtctaacaattatcaaatgatgctttgataatcataaagtggtgaggaggctagaaagacaatatggtcggtatattttgaccttggaatctagcagatgaagtagctaatgacccacagttttaaatattcagccctaattttttccctcagactgctatattaaacaattcattcaacatctccactttaatgcccagtagacataccaaactgaactgggagaacacaagtatctgattttctgcacaagctaatgaggccaaaaatctttgacttgtcttctttctcctcccctatatcttatccatgagccagtcctgttaatcctatcaccaaaataccaattatacctggccgttcctcactgtctctcctgatgccaccctgatggaagccaacaccagctcttacaggcactgctgcagcagcttctccacctgccttcagcttcccttcctgccagctttattctgctgtctttgctctagccagtgtgaactgttaaaaacatggctcggccaggaacggtggctcatacctgtaattccagcactttgggaggccaaggcgggtggatcacttgaggccaggatttcaagaccagcctggtcaacatggcgaaaccccatctctactaaaaacacaaaaatcagccaggtgtggtggcgggcgcctgtaatcccagctactccagagtctgaggcaggagaatcgcttgaacctgggaggcagaggttgcagtgagccaagatcaagccactgcactctagcttgggtgacagagtgagactccatctcaaaaaacaaacaaaaaacacagctcattccctagattaaaattccttaaaggatgctctgcgattgggtgtcagcctctctcctattatcatcttttacaccttctcctctgctttctatgctccaagaactaagtcttttgtctgttccttgaacatgcctagctcattcctgttgcaaagcttttgcaaattattttctcctgcctggaagagtcttccctaagatcatcactcaaatggttttcatctttcagtctcagctcaaatgtttcttcctcatagacctttcagagcaaccctatctatatagcactcgactgctctctgagtcactccagccttacaggtggatttattttctaatgattagtactatcttaaatgatctatacttgtttatatgctcattatctgtctcctgccactgtctctgagttcagggacactgttttgttgactgctgcattctccacacccagagtgatatctggcactgagtaaaggatcaacaattatttgttaaatgactaaatggaagtcccaattctaaatgattcatcccaagtgctatacaaagtgagctatagtagactgacttaagatgtttgagctgaaagggagcttcagatgaactccactgttctagttcatagacatggcctagctgaggacatctggcaccgagtttgaagcaattcttttaagtaacagctttcctggacagagtaaatctaagagccaccatcagtaatagacattattgaaggtgataagcctttcaaggattgtaaggggctcaaccactggccatgctgctggttggaagttgaacaagacgaaaagggacacagagttgagaggatcccaccaggcagagttctgggaacatgagaggcagccatatctcctttctctgtccaggattacctctaagtatccaagacattgttgaaagacaagtatatttgtagtttatagtgagatcctagtgctggtaagaccagggacactggacatttctaaatcctgcctggaccttctcatgacatccctgaatgatgtataaacacaggacaataggtctgggaagcaaggcaccactctattattggctgggccagggctttgaactccagtatagagctttctggcaaggtgtagcactgagattaggctcaaggcctaaccaccagatgatacaagcataccccaccatgcaagaggaagagacagcacctgtctgacctgaagggctgaaccatatggaattcagaagcaggaaggacagagaacaaaagttggccaagcaagtctgtctgggtccttttgttgatctggtcttatgaagcaaagaaacaagagaggcaaaaccatgggcatgattttctaaactacatgaggtgcaaaaaatgcaaaacatagttgttggccttaaggagtgtaaaatagagtcagtgaggaagatttatatgcagaataggcaactttgaataatatagaagacatcagtcagtgtaaaccccttgcagttaatggtgtttgttttctttcagtgtcactagctataataacttaagagctcattttcttttcccaaggcctgggtcattagagagacaaggttttctcatgacctctgtcatttgcccagccctgccaaggtaccttgccacagagggcagggctgtggccaggatccaggtgaatgggttatcccattacagtgctagagtgggccatgttaggacaagcagtcttcacgactctcaggctcaaggaaaattatatgaaacttggaacccagaattgcctgtttgttttgacagtgggccctgtgcccttctctactcttaatttatgacagttgcataggcattatggaagtagcagatgtgggaaggactgtttaaacattgactttccttctgatactaatcaagttagttttggacacagaaattggtatgaccatgaattattcctttagcaaattgcgagttctttttccatggatttatcatgtaatacatgcacacacacacaactttgttttctttattcccttactgcttattctgaagctgtcattttggtatctttttcctctgcttactttgactttctttgtaatctttctatctaagtcctgacttcactcctttccctcagacaactcactgaaggctctagtctgagtattcttaaatcacactctgttatttttaaagtacaattttagctctgtcatgtgtgccatgttttctaagaatttatgggcatatttacatcaggatctaccagattttaacaaaataatcttaactcttttgctagtttcatttatgagactttcattgcactatgaacttcaactctagaaacagtggtgacatggctttgataattctggagcctttttaacagtctcaagtgagcgggataattttaaaacaagctgacctcccaagtagagtacctgggcagccctctggctgtaagtaaggctgtggtctgttctcttttcggtgtaggcggagggccatcccgcttcagagccctcacttcacacacaggatgttccaatgtggatgatgcaattcttatcacaaacaatctacaaaggattgagatatgtttaaaatcatttcctggagtttgtggtgatatgcactctttctgtttgtctaatctgaaggcctgttgcaagaacaatctgagctcattatgtgactcaaaaaccagagagaactgcaatctctctgtgtgatgaggactgactgggaattagggtatttccagttgtagaaatgtctttcattctaacaaggactagtgcattctttttccttaaagagagaggagaaatagaaagaacaagtgtcatagcaaaaaataaaaataaaaaaaatccacctatatatgagcttatagttttaactttttaattgagaaaaactttaataaagctctacatgtgttatgaatatagcattgtcatccacagatgtgcctataggagaactttaaataaaaaaaaaagtttaattctataacagacatcaaagattatgtcacgtgatactttgataataacaccacctggtatttattgagtactctttccttgccaaacatgtaatacccataattactctaggagctttgcaaaattattaccccctttacaaatgagaggagtgtgactcagaaatgttaagtaattaacctaagattacagagctgataattaataaagataggggaagctaatgcaaaatgagacaaaatgttccaaacgtacatatttttgtaagtatccaagaaggagagtgacaggatgtagttggcatttataaataatatttaaattttattttaacataaactttatgaagtaagagaaactttcagaatcttgaatgaaaaattctgttagagaatttccaatgttagcatcattggctttaccatcagctgtttcctgggcaaagatgatagttaccatccatcttttcatcctatcatagacaggaatttcttgtatgaatatactcaggagccggagcacaagggttttaccctcagcttccccaccactccctgggtgactttgggaaagtcacacaacttctctggagcagaaagtatgccatccttatcaaactggaatgttatgagcaccttgtgtgagaataaaagtaaagcacttcagggctgggctcggtggctcatgcctgtaattccagcactttgggaggccaaggcgggcggatcacttgaggtcaggagttcgagaccagtctggctaacatggtgaaaccccatctctaccaaaaccataaaaaattagcagggcgtggtggcaggcacctgtaatcccagctccttgggaggctgaggcaggagaatcacttgaacctgggaggcagatgttgcagtgagctgagatcataccactgcagtctagccttggcaacagagggagattccatctcaaaaaaaaaactgggtcctccctacctcttcctatcccctcaaccaattctcatctgtcatggatgagcttccatgcatattggattagcttcatgaagtccatttcttcttcttggccaagaatgctattctattccaatcctctttccaaaataatcatgtctttgtcttttatgatatagccttttaaatattagccaattatcatcctttatatctctttcaaagataaaagtctcttaccattaggttgtcctggcagtgccatttaacatgccaacttcatttattcacagagtttgcttatatcttatttaattaaattaattaattaattaattaatttgagacagagtctcagtctgtcaccaaggctggaatgcagtggctcaattttggctcactgcaacctctgcctcctgggttcaagtgattctcatgcctcagcctcctgaatagctggaattataggcatgtgccaccatactaggctaatttttttttttttttttgagacggagtctcactcttttgcccaggatggagtgcagtagggcaatctcggctcactgcaagctccgcctcctgggttcatgccattctcctccctcagcctcccaagtagctgaaactacaagcgcccaccaccatgcctggctaattttttatatttttagtagacacgaggtttcaccgtgttggccaggctgatctcgaactcctggcctcaagtgatcccatctcagcctcccaaagtgctgggattacaggcgtgagccaccgagcctggccctccttttattttaaattcataacataaatattccttttcttcttccattcaattttattttttactcataacttagtccagtgtttgattctataaagacattagaaatccaactgtaatatattcttacacttttattttaactttaaatacttactgttaaaaattttataaatacttattatgctattgctgtacaattaagccatcctcagcactattaatacaggtatccaaagtggcatgtctcatctcaacaatgacaaccccccaagaggcggaggttgcagtgagccaagatcacgtcactgcactccagccggggcaacagtgagactccaactcaaaaaaaaaaaaatctatagtaggaaggacactttaaatatctcctgatttgcttcttcgttccttcactctggatacaagtttgtgtgtgcacctacaaacacatgaatacatacacacccattgtttgtgacttgcacgtgggagagatatgttgctccagaatgtctgctgtgctttaatgatctataaaaatcctccatgcctcaccaacaagtcttataattttaagctttcctctgtggtaatgtgtgaatatctgtttctggaataaagttcatttacaaaggtgactgggacttacacacacaccttcctagtatctagttgtctaagacatttacatccatctaactccatctaaagaaggatctggggaatgctaagtggcacaagtggcaactatttattaacttgctgtgccccatatgatgggaaagcaaacagtgcttctctagaagagttctaagggaacttaatatggtaaaaagaaccagcaattttgagcaaaagggcaggggtgcagatatataggttttgctttcacttagacccttgaagtcagtttctttaaatgaaaacataaatagttatacacttgacctcacagagtgtttataaggatcaaaggagataatgcacataaaaaatgctttatgagctataaagcagtttacaaatgttgctattccagtttttatcattgatgaaacaaccatctgccaaagcacctagttgaaaggtactagctcatgagctttgatttgcaaaatgtgatggtcttaaaattatccccctctctccctccaatagccaagaacaggaatttgtatcatcacaaggctttagggttagtattttagcttttgattttaaattcaagaaaactgcatgtcggatgagaggaagtaacataattagtttttattgattatatttcttctagtgccaaagccaatttctggaatttttatgagacagaacagtaagcttaagatgttttagcaatagtgaagtcagtggactctttatcgtgaaacggaaagatgctgaggatctagccatcccgctaactgaggagacaatgtggaagcctaagaagtctgaggcagcataatgaggcctaaatactaaaattgcctttcaatatatgccaaagaatttaactattaaatttatgatagcagtatttccaaataaaacctaaaaaatgaaatgactctttttacctgtcttccttcttcccagagacgggcagccttcacgggtgaattctttccatcacaaattcattttatgtttaccagcagaaagcaggtaccatttagagctcaccaagcaccttgtgttgtccgtggcctggaactaaacaatataagaaacaatatttatatttatatactatagacttggaaaatttttacgtgcatgtagatacaataagtttctaatccaaagtaaaatatccccttggatggctcatagacctctcaaacttaaaatatctcacagtgaactcttgagctccccctatcgcaaaatcttgctctactgacagcatcccctttaatctgatggtagtgactagtttcttttagcttctcagccaaacacctttaggctgtctttgactcgtattcattcattcattcattcattcattcattcattgaaagaccaactcctcaagaagtcctgctgcccctaccatcacactctatctaaaacaagaccacctcttaccactttcccttctgccagccctgtatgagcactccatcatctgttgcctggatgattgcagttgtcttctaagtactttacatgactcacctgtgcttcaatacaatgattcccaacagtgtggccttcaaaattcttctacaatatgtcagatcacatcatgctgtactcaaaaccctccaatggcattctcatttccctcagctggaaagctgaggccttctattaatcattacgtacaagtcactacatgatctatcattaccagtaggactaccatctccttccactatccccctcactcattctgttccagccacagggcttttgcatttgctgttcccgcagcctagactattctgccactagagtcttaaggtttactctttaaccttcttcaagtttttacttaaatattaccttctcagtgaggccttccctgaccattccgatgaagattatactgctctccaccccacactcctaactccagcctgcttatttttctcccaaagcactgatcactaccactatatggtttacttacttattacatttactgtctattttctcccactagaatgtaagctcctcaggctagaaacttttttactgatttattcactagtatatcctcagtacctagaatgaggtctggtacataataggtctggccaccacgtatagactcacagattgtatactgcacaaggcctggacacaccattcaaggaatggtgtcccctggggttgtgtaccatttcagtccccaagagcccaataaacatttgttataaaattgaataaaacaaaatgttttgccctactattttaagtacatctctgtcagtaatctctggtaaaatctctagtattgaagaaaacacttggagaatttacagactcacagaccaaaggaagatatttataacagcccctagattgtgggtttaaaactgtcctacctacaccaccataaatactgcttgctaactaaacaaagtattttgaattccactggaggtaggcaaattggctgtgttttgaaagtctacataatcactattttcccacaagataattgaacagtaagtgttatttaaagtagtcttggaagaattcccagtttcactggaggaaaagaaaagtttatatcttgggattttgttttgttttgagaatcagcacacatgcctgttcatgcaactcttttgtctggttgggattaaattaaatccattacttcaaagaggtttcgccatacttcaacaggtatactcaccaacatatccaatttcccaccttggtaacagtttctcttggtgtgtctcttcctgcacgtaaaatttcatagagaaatataacagcctccctcatcttcctgtctgattaatttaagaatgccacaattttcttggaatagcctcttggtgatgtcctagcctcttcttatgagggtgagttgtcaggaactaggatttcaccgaggccttagggtgtgaatgaggaggagagtctgctggaaatgtttctaataaagaaggtaagcaaaggtcagtgacttctctgtagtcaccaacatgacctgtagcctacttattaatgtggttcacaatatttaagaaatgagtcatatatgatgaggaaacccttgttcttcaagagttaccaaagtggtctggttttccactattttctattgccttgtgttaagagtttaagatagcataatactgtcagagatgtatttgcatgtatcttttagggaatttcaagtgcttccacatccttcttgttaagtgccacacaactgcacagatgcttacttttctcttctttctgattaaattagaagagctgcagttttcacagaggtggtcatgatgttatgacccctcctgtgctgcaaggttatcaaatcctgaattcttagaaaaggtggtaggaggtgacagggagagtgtccagggagtgcttagttgagagaaaaaaaccaaacagtcttctcaggaagaaaatagctagttgttgcagctttgctaccagaggctctgataaaaaaaaaaaaaaacagttaaattttagatcagacacacttctctgttgtttctcagcaagcctctctcgggctgtggtgaggatggttggaaatgtgcataatagaatcacctgaatttggtatttgcatttggtattgtctgaacataccctgttcctacctgtcattgggtttgtatttggtgttgtctgaacatgccttgttcctacctgccattgagaacagtgtagcctaggccccacagtatggatgtaccctcccaggacagctgtgcttcgtgtccagtctgcagccccttcatatatcacacagccacacaccccttcacataagtgtggcctgactccctgtgtctggtttctaatccatgctagttctagaacccacctcatctgctaagatcattttcccaatctgggccctctgccaggacttcctgcagctaagaggaaggacactagcctaagcgttaagaacctgggcttccgcacttggttttcactagccatgggaacatgagcaagtcactcatcaatctgtgtctcagtgattccatctgtaaaatgaagtgtaaaatggggataagatcatccccggtggccaggcacagtggctcacaccagtaatcccagtgttttaggaggccaaggagggtggatcacttgaagtcaggagttccagaccagcctggccaacatgatgaaatgccatctctattaaaaaagtgcaaaagatagctgggcatagtggtacatgtctataatcccagctattcaggaggctgaggcaggagaattacttgaacccaggaagtggaggttacagtgagccaagatcatgccactgcactccagcctgagtgacaaaagacgagaccatctcaaaaataataataataatttctggcttcttctgcagatgaaattagataatctttggaaaggcttacacatagtaccagatgttgtaaaatttactataattaataggaattaattaatgaatgccaaggggcagagccacacttcctatgatagttccttgctataaggtgctattttgttctctacatttactccatagtaagcttttgtttgagaaaaaaaatgccagtttggtgcgtagtagatacgcagaggctgagaaaggaacagatgacacaataacacaatggtaacagaatgtataatgcttccctctcaacttggttgatttgttttttttacatttacttggaccaaacaagcaaaaatacatgctccccagaagaacagaaataaggattttctttgggaggtggaggcgggcggatcacctgacgttaggaggttgagaccagcctggcaaacatggcaaaatcccctactaaaaatacaaaaattagccaggtgtggtggcgcgggcctgtagtcttagctacttgggaggctgaggcaggagagtcgcttaaacccgggaggtggaggttgcagtgaaccaagatggtgccactgcactctagcctaggcaacagagtgagactccatctcaaaaaaaaaaaaaaaaaaaaaaaaaagtaaggattttctgcttaacttttccttaatcaggaaactcttttttaaatgatagcatagaatcatccattcatttgcttgttcatttgctgttgttttttttaactcatttgttcaacaagtggttattcattgctacaggcacagaattcctagccctcatgtacctttcctctctagtgagggatttagtcagtaggaaggcagctatggggcaatatgattttttttaatgggatgtggaaaggtcagaggctatgtaggtacttagggttacctcgagttaaaagagccgggggacttcctagaggaagtggtgtcaaacaggagatcaaactaatgagtagacattgccaggcaagaaacagcatgtatgaaggtttagaagcaacagagactctaatttgaaggagaagctaaattcgatatgactgaaatgtgatttcaggaagacacatagaaaaagccagggttagagaagaaagagtcagattctttcctttttacactttaagatatgtccagcatgcaaaaatcagagttaatgctgtgtaatactactatgaaatgaagacctgtacagatggagaaaatcaaggctctggaagacaattttcttggtaccgactctataagattcctaatttcttctgagctatcatgaatttgaaagacatcagatatgctcaaacacgcgttccaattctgcactggttccctcccttcattaaagtggctattgggacttactaacatccaacattcagatttctatctttttcaaaagccttaacctatctgcctggtattattgtaaacctaactatggtaatattttaaaaggtaaattatggtaaattattagctcataagaagaaaaaatctttcaactctaacgttaaggctgactgaattaaagtgtgctagagtgttctatcttagtttgagaataattttataagatgaacgaggagagaacttattaatgaactattaactttcaaaataatctgcattttcctttttccctaagtgttcatgctattctgtctgctaatacttcaggttaaaaccttcatcctttggtgtccatttttgtaaccttggaccattttaatgttttttctactggtaaactagatcatatattccaggtcatttggatttttattttacttgtcacatatatctagttttactagatttagaagacagcagtctgctttaatccttttgtatctaccgtacctcaacatggggcatatgttgtttaaatgataattataaaatatatatacagaaggctcatgaaagaattttagtttctttgatattttaacccttcccaataactgacatgaaaaaaaatggaagcaaatatgcttccatattaattgaatgctgctgagtaacctgctgcagtttctaaagatcaaactgatacctgggctctttctgtgcaatcttctgtggttctaagtgtcaggtgagtgcttctgcaagaaaacccatattctctaggtgaagttctgaaggaaatgaaactaaccgaaggaaggacgtaaacaccaatctcatcctgtattctagatatatgcactttgttacacataaagatagcttgtaatgtatttgttctgtatttttgctaagtatcctcttataaagacagttagcataaagccactaagataagatatctgctctctaaatgagtcaacatatgaaaatgcttagggcatagaaagcactcagcaaaggctagttgttgttcttggtttaaatttggtttcattctttagagctgtgctgaacaatacgtagccacgagccacatgtgactactgagcacttgaaatgctacttttccatattgagatgtgctctaagtgtaaaatctacactgaagttcaaagacttaggaaaaatgaatgtcaaatatctcattactaattttgatattgcatgctagtttggatatattgagttaaataaaatatatttttaaaattaatttcacctgttgctttttatgttcttaatgtagctggctactagaaaatttgaaattatatatgtggctaatattcgtagcttgcattatatttctattggacagcattgctttagagagactttctagggtgtgtggcaatgcagcagtgttacagacattgatcaaagctctttatcagctaagcagaaaggcagcaggtcaaatcatagctgaacaaatataaactgttcacattgaaatttaaatgtgtttttcactgtttgtgatcaggtttatctttaagaaactatacttaacactttgtgtctaataaaaaaaatgtgtttctaggttactggttggttcaccctggagtggctttcctgagaaccgaatgggagatgtgtataaatgtcctgttgacctatccactgccacatgtgaaaaactaaatttgcaaagtaagtttaaatttacttgcaaggcatgtgatttgtcttagactcaactgaaaaataacatcagaacaatcattgttctgtcttaaagaaatacagacagcttttttttgcccttatgtctttagtaatatggggcacaatcatatccaaatttccaaaacagtttggagacttgacttaacaagatgcgtggaaaatgtgctatctcctggaccatttacctatagaccatggactggtttccatcaacatttagaataattttgatgattacttgcagaatcaaggctatccttgaatccgaggctatccatatttctttctctcctctttgcaaaataaaccattaagtttggaaacatcagtacaagggctgagtttggaggcaccaaaaacactctgtgtttcttgttatgtctaaatgatggcattctaataaaacaaatccacaatttggaattatttgctgttttaattatccccatctcagatgcctcctattaatgccaaaaatttactaaaggttcaagggtagacagctaaatgagtgacatttccatgtaatatgctgatacaagtaaaaagtcactcaatttgatcatcattacatcatcagcagcagcagcctaaaaaaaacagccctgaggaatcacggagttcctctgaagaattgaggcatgaattagaaaagagtgttgtgaaaatcaagggaaagaagagtttcaaaaatagtgattaagacttggaaacaagggcagtggtgtttcttgcatatctctgtagacctaatatctagaataatttatggcacataatagggctcaataaacatattttcagtgaagtagaaggaatatcagtagtgtcaaatgctacagaagttgaaggggatgaggactgagtaaatgtcttcagcttatttaagcaggttgtgggtgatctagatcagtgatctccaaattttttgaacactcagtatatatatatatatatttctaataacacaaatatatacatttggagtgagtgttcaaagctttattatatagtccaaaaattttagtatatcacccctaacatttcatatcacccttaacttctgaacactcattcttaatgtatatatttttattatttttaaagctatatacatgtactggcctatcttctcaataataccttcacataaaaataaattttaaagaataacaacatgcccatagaagttctattattttctgtcttcactctaacagatcatattttgtgtaacttactcacctagaggataaatccaccagtgttatggggagaaaatagataacaaagaatttaggagtgtgtcagtagtgaatgtacaaggagtgaaagttgacctccatttccagaagttcagcagtgaagggggagctgggaaaaacaattctatgggatagcagtgtgagaagatttttctagtaaacaagagatgatactttttgtagggaacatggaggcagcagtaaaaagggatgatttgtccaggatagagttaactgattaaaattaatgtcatttgtacctgagaaatagagtcttaaaaagagttcttccttctctaagacacaaaggaaggagagaaaaattaggagttctaagaatgatctttacacaatgattagagaaactgagattaccctggaagtctgattcatcttctctgcagtagtcgttattcactgagtgatgggatctgagttgaggttggaggcttgaaaagaaggggtgaacttggctgggcatggtgtctcacgcctgtaatcctagcactttgggaggccgaggtgggtagatagcctgagctcaggagttcaagaccaacctgggcaacatggtgaaaccccatctctactaaaatacaaaaaattatccaggtgtggtggcgtgcacctgtattcccagctacttgggaggctgaggcaggagaattgctagaacccgggaggcagaggttgcagtgagccaagatcgctccactgcactccagcctggatgacagagtgagactctgtctcaaaaaaaaaaaaaaaaaaaaaaaaaaaaaaaaagaaaggtgaacttttacaacagtcaccctgggaaataagggaaggaatccaattaagaataagtgacagaggcaatgatagcttggcagagatgagaaacatgactgaatgatggtattactaaagagaattgcaatgttcgataactcaagaatggatacagtggttgatgccctaggtcagtggaagacaggaggtggagagatttatttagtatattatatgactcgtctaatttccttttaacattcacccactattgctttgagccagattctatcatagggcattctttgataacacttcaaggatatttttactgacccagaaaaaaaaaaaggcattagatagagctactgtgactttcaaaagagaggcaaaaatgatgtcctcaaatgtgttttgttttgctagaatattgtaaaaaaaatcataattaaacatctataagtcataccctctccagagcccactccttactgtcttatgctctgcagcctcacacattaatgtgcgttaccagatcactgaaagcatcgcgtttccccacacttcattatataactcaagtacctatattgatgacactaaattcaatgctacatgcaaacatgggtgtgcctgttttcttttaatatctttaagtaaacgaggaatttttaatcacttttaaaaattgttttccctttgaaagcttcaacaagcattccaaatgttactgagatgaaaaccaacatgagcctcggcttgatcctcaccaggaacatgggaactggaggttttctcgtgagtgtttactttacaaatcattattcctctcaagaaagtacatagacagtagtgtcttctcaccatccctcccaatctgaggatttagatgtttagaacttgctttttgataaattatgctatttatttggctatccaatgttgaatattcaaaataatgttgatgtgtagactttttaggatattcagcaaaaccactgctactgaatgttttgaagaaaagggaacaaaaagaaccctgattctttgcccttggaaagtgtgctgagtatttgttgataacagcagaatcccaaatctcatttctacttcctgtaggatcattcaagatagtttcaaagctaaaaagtatttttggtttttaatcatttcctgtaattgttgagtaatctggtgttatctgaggcatggagcagtctctcatgtcagtgctcactttcatttagttacaaaaagagtaaaaagacatcactaatcagtgaaatagaatgccttatttaacaagtgcttttggaacaattaattgattaatatttacatatccaaatacactgtcaagtgaattgaaagttaatataaaaaaactagaaaaaaatggaaattttctgaaggatggaaaaatttctgagtttagagctaatagaaaaaataatataggaaattgttgaaaggatttgactatataaaaaaagggaaaaacatcacacaccaaaaaaaaagtttgaagacaaaaacacaatcttatttgaaatttccattgactcatataggtatgtgtatgtatgtataaccctgttaaaattgtcttagagaggttgggcgcggtggctcatggctgtaatcccagcactgtgggaggctgaggcaggtggatcacatgtggtcaggatttcgagaccagcctggccaacatggtgaaacccatctctcctaaaaatgcaaaaatcagccaggagtggtggcacacacctgtaatcccagctactcgggaggctgaggcaggagaatcactgggacccaggaggcaaaagttgcatgcactgagccgagatcgtgccactgcactccagcctaagcgacagagtgagactctgtctcaaaaaaaaaaaaaaaaaaaaagaaaaaaaagtcttagacagcataattcaactttacactagttttatctgaaccattggcacgcttccttaaaaatcctatgttttataactgtattattctaaaaatgtaatcaattttcaacgtcattctatttttactaatggatattattattctgatgactgtgctgccagtaagtgaattagatattgcttgtgatatgtgttaacatcagtgcataaatgaatattgcaatggatctttatggtttatgatattccaaggtctttacaataaggttgctttaatctttttgttttttgattttaaagttgcaaaaatttaaaaaaagaacatactgatatttagagattacagaatgtgcctcaaaatttttaatctataactccagataaagtaaaaaatgaaaggtaaaaagcaagagaatttgagagattaattagcagtccgggtagcaagcagagaggcagaaagagagagaggaggagaaagaaaaaaagaaaaaacccaaagtttcctttacatacttagaaggtcaaaatcataagatactcttaagaattatgtggaaaagactgacaatcatcacatttttttgaaacttcttaagttctgggcttaaagtaggaatgtagttctggcacttacaattggcatattttaatttcaacttcttaatgctgttttccattgcttttaaaacaaaaaaaaattttgaatacttcatgagttctttttcaaagtgattttaaaaaaagcttaggaatggggatatagaaaccaataattagtatctgttatttggtaaactaaccaaagacattaataatgactttcttctaattaattggcaaaataaatcagttttatagggagaaaactatgccttgttcattgcacatgaaatatggccaaagctgcttcccctttgacagttaaactgggtcaaataagttttcttttatttttccaattacttcttgcaagcccatactcttctgttcagttttataactgattcacaactttacataacgttaaattctgtaggcattttttaggatcttaattagatttctcttttgcacttgtctcctttttcatgtatcaattttaaagttatttaatctaatgtttcttgtgtcatttaatcatgatttaatcaggagtttttggcattcaaggactcctgaaaaggagagaattgggattgcattaatggagatattaaggattggagcaggtataatgtgagcaagaagacaagtgccattcagcgttagtgactgcagttaattgggaagtgggcaaagttaaaaactggtagtcagtgaacctcatttgtgtttgcttagcatatggagtaattttgaactgaattttcacacaacatttgccctctcgactctcttttacaaattagggaatctggcaacacaacctatttcatacccgtgggcaggcagaaaacatagtggtctgtacataggcatgggttcttcattcaccatgatgtctatacctgaccccaagccctcttcaagcgttactgccattaggtttatggtttctgctgagcagtatgaatggaaggaactgcagaaaactaatgttcagcaagaacaatgataatgatgctagctaacaatattatatggcatttgctatttacctggcattgttcttagtgttttgtatctatagacccatttaatctttacaacaatcttaaaagatagaatgtgtggttatcctcattttacagatgaatcacctgaggcccaggtaaatgagagacaaaaagtgaacctgcatgcattctcctccttggtgttctctggaaggaaagcacctgttttatctagcttgttgggagacctcataggctcctcccttcactgacacctgctcccaacagtctcagcactcctcctcccgcaaggcttgccactgggcacagagcacctgccaccttctccatcacttctgctttccccgaaggcattactgactcattggttttgagttgacaattattagtatcttagaaaagagtagagatgatttctgagctccataatggagaggtagaaggtttgcatttttcatgtgtttccattgattgttttctcatttctttgaagacatgtggtcctctgtgggcacagcaatgtgggaatcagtattacacaacgggtgtgtgttctgacatcagtcctgattttcagctctcagccagcttctcacctgcaactcagcgtaagttattaatgtgcagatggtctgagcaatgccttacagttaaaggagggggaaaaggttatcaactagtggcacccaaaccctccttaagtctcatttttatatggctgtgaaatatgacttacctgtggaaatctgcttctttcctcttttcctgtgtagcctgcccttccctcatagatgttgtggttgtgtgtgatgaatcaaatagtatttatccttgggatgcagtaaagaattttttggaaaaatttgtacaaggcctggatataggccccacaaagacacaggtatggctagcagaaatgcataactaacttatggctttctttctgaaaaaaatattgttagctatgaagtcttaatttttgtatttgccaaatccccattttaaatgcatttgatggtagtttttaaagttaattgaaacttttactacattgggttattctacctatggctttgcccagtgctggtcttttgaccttagagttctatttctgacacaagcattaaaggtatgggacataacttttttttttttttttaagaccaagtcttgctcttgtcacctaggctggagtgcaatggcacgatttaggctcactgcaacctctgcctcctgggttcaagcgattcttttgcctcagcctcccgagtggctggtattacaggctcctgccaccacacccagctaatttttgtatttttagtagaaacaggatttcaccatgttggccaggctggccttgaactcctgacctcaggtgatccacctgcctcagcctcccaaagtgctgggattacaggcatgagccaccatgcccggccaggatataacattttaatcttcctttagtttcctgtctttcccttctaacccatgagttacattttaaaattcaatatgtatttttatgtccatttggaccaataattaatttcttttgtttattccttgctggtaaaacaattattgaattctgaaatttgtataaataagtcactaagcatagttccagcatttatgataatattttatagttatttatcatattccagtttagcttgcccttttgcctacagaaaaggtcttttcaataattttatatagttctttatattttaagaagtctttaatttgcttttacatcttcttgaggtaggcacctaaagctcaatagtattattttaaagttcagtttctggttttggattttttttttccctttctgattgaatctgccatttcctgagccattctggttgtagcagtatactgaaccagtgtcaacccggaccagttcactgttaccagtgtatgctcatggattgcatcttatactctaatgtccaacatctaatacaaattgttgacatatttttccctaaatgctttccagctatctttattgaaatttgcttctctgctttcctgttcactattataacatgttgttatatgtttctcccattgaaattgcttttcagtaccaagagtatctcaatacccacagaagctttggaaatttccctgtgggcattttccaggacattccgctaaataaaactacatatagcactggtttccagaaagcaccactcttaaagccccttataagttttcatatgtatctccttatttcctctgtttctaaatgagttaccctcataatgtgactaattttatttaagtctcctatatagaattcacagtcttcctcttttgtgtcttcctaccacagtgcatctgattcctctctagaagtggtttaactcaatctcttttcttacagcctaaatttgaccttcctgtaagttctaacctaccacatttctttaaatcttttttcttctttttcacacagaagtcctggggctctgtcgtgggattactaccatcttcctctcgtattggactttgaaattctcagttattttttattctttcctccctctcaagtcttacatccctagagaaaggggtccaggaatattatatttctcactatcttcccagtgcctagctcactgctcccttggcaaaacacagcagatggaactcagaaatcccagtcctcaccgcttccacctccttacatactgacctgtatttcagagagcctcttattgccattcagagatccctcactgccactcctgttctggaaagcccatctcctaggcttagaggatgatctcaatgcctgcaaacaaggacattaacagaagggtgtgaccttattgatctctaggattagggaatgctcccaaacatcttgttcagaaattctttcaaataagatgctctccagtggcattttctctgaaagccagaaactccctgccccatatgcacatatagcatcttctttccagtgttgttgaagcccataatagaggaaattcagcacaataaatagacctcaattgactacgctgattaggagcacattggtttttgttgtattcaattctaattatttattacacagttaccatcctttgatgagatgttactcttcatctgtgattgcttatagttgttcgcgagcttctgtccattggtaattagaaagtttatttatatcaagtttaatcttcctgttaaaaacagtgttctaatagtcatccatattaaaatattatatggcagtattaaaaactacaaatattactcttgggaatcaaatcatacactgtagcacatcatctttcttggcaatagtactgctgttgtacactgatggcctctaacagagaagaaatcattccattgaaagaaaagtaactatcaagaacaaagttggaagtgatgccttaaagctaccggcccatgtctaaatgtacttttgatttttattttattggttaagtagaaattatttttaatgtaatgacagcccattaataaatgtctcctctgttgaaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaaggtaagttttggtgctaataggccaatgttttcataatgtaaaacattatatttatgtaataaatatgaaaaagtaaggaaaagacaaagaaaaataatatacctggtacctaatttaaatcagaactaataaagaaaaaaacatcagagcattctatgtcttgaatactttgagaaggcagctgggaaagttaaatctttgattttaggatatttataagatatcacatgatatttaaatgaatttatgtgaagtaaatgaaatgagaagaccttagattaaaacagtaggaaatggggcaatctgtcataatttgttaatattcatcagagattcagacaaattgagctcatggatcacttggtgcaaattaacaaagaccacagaatcttaaacatacgagtttaagtttattatgcttattacaatcagtgggaaatgtgaaattataactatacaggactctcttgattcttatctcaatttctctattttctcagatccactgacctttcttttcactctattttttattttatttttattatactttaagttctgggatacatgtgcagaacgtgcaggttcattacatagtatacacatgccatggtgatttgctgcacccatcaacccatatctacattaggtacttctcctaatgctatccctctcctagtcccccaccccttgacaggccccagtgtgtgatgttcccctccctgtgtcctcattgttcaatgtgctctcattgttcagctcccacttatgagtgagaacatgcagtgtttggttttctgttcctatgtaagtttgctgagaatgatggtttccagctccatccatgtccctgcaaaccagataccttcacaaaaatgctaaacacactccggttgttaaacaaattaatgagaacaacaagcttgccttcccttaaacctattctctctctttgtcttgtgcattccttctttttaccaccataattctttttgaaaaaagcaactctattccctccctctacttccttgaaacttacagttctgccactagataagcatgaccctcttcatcccccaaccctgtggtcccaccttaaacctcatcctttctggctcctctgaacatttgataatgatgaacatacgctgctattcctaaccaagttgccatgacaccacaaacttctcgaactcctgccaaattcttttgcctcttcactagctccttttcctattttttcttcactaaacagagccctctcttctttactgctcttctcctgtagggattctatccactgtcatggcatcagcagcagcactgttgggttatctcattgctatgttgtcagccctacactctctcccaaaactcacactggcatctagctgatgatgaatatttttatttggagtgttggctcacttaccaaattcaatctgtcccacactggccttattcttttccctaccactcctcatgaacttgccattttgattcatgccactgtctcttgcctagtcagtcgaactaaaaatttggtttcctttattctttccactcttccttatgtcacacatctggtcagtggccacatcctgtcatttctatttctgcatttcccattttatctgtcttctttttctgtgtgtgtatttcagttgctacttccgtcaactggtgacaatcccaaatgtctcaaaagcagattccccacaagagaagatatgattggtttggttcatcattactgtctctattcagggacaataaaggttttttgggccaggccatctcataagctgctggccagtcaataggtcagctgccattaggtgaagcgccctttctggacacagcaaactggactaaaaggacaaagaagttgagatgaaaaatggctttcctggagttagaaactgcaacggcccggttttcagcagggaaggtgggagtagcatttttccctggaaggagcctggggccctggcgagctttgttctccaggacaatggccactgtccattgaggaaggacttgcctggctttcatcatgtttcaaaactttggttttctcccttgggccattgtctatctccctcttcccactatttcccaagctaacaggttttagtctgcccagtgctaggagaatcacccaacattttactcatccctcctagaatgtaattgcctgtctctctctctctgtctgtctctcatctctttctttaaaacattgaagataatctgaaattatttcagtaaatgttgccatgttttcattcacctcatttcattcaatgcctacagttgcagtttattgttttaagcactgcgggtaattaaaactaaatgagacacagtttctgtcctcaaaaaccttagaatcatacatgaaatttacagtgtatcataaagagaatgtgacactcagaaaggatctgatgtggatagtgtaattcaaatttggccgaaaaatgcagaatattttctatgtttctatagtctacattatagaatacaaaaaagattttaggaaataaaatgatatgctcagttttataataaactgaaactcatatgtttaagattctgtggcctttgttaatttgcaccaagttatccatgagctcaatttgtctgaatctctgatgaatattaacaaattatgacagattgccccatttcctactgttttaatctaaggtcttctcatttcatttacttcatataaattcatttaaacatcatgtaatatcttataaacatcctaaaatcaaagatttaactttcccgactgccttcttaaagtattcaagacatagaatgctctgatttttttctttatttgatactatctattaaaatttgaattgtgtgtatcctgtgtcccaataattttactgctaagattttatcccatttgaaaaagtatgccaagatatatacacagggatatttattacagccttacttgtaaaactcaaaatgtcctaagcatccaataatggggaaccggttaaataaaccagtcttccttcatatggtcctccaaataaaatattatgcagacatttaaaaaaagaatgagaccttcatgtatatacatgtgctgatatggaaaggtctccatcaaagtaaaaaacaactgtttagaatatgccctcatttgatgcaaaggcataagaatgatacagtggactctggggactcaggggggaaatggtgggaagcgggtgagggataaaagactacaaattggattcagtgtattctgctcaggtgatgggtgcaaatctcacaaaccaccactaaagaacttatttatatgaccaaataccacctgttccccaaaaacctatggaaataaaacattttttaaaaaagaatatgccctcatttgagtaaaagtttaaggggtagactatgcctgtacctatattacatctaaataaaacattttctagaaggaaatgcaagaaactgataatggtgcttacctgtggagaggggtttagtgtcacatttggtttatacctttccaaatactttgatttttttttaactgtggatatctattacttttaaaaaaataagtattgataaagtaaacacaagactaatgcataaaatttataacagaaatatctttgctttattaattcatactgattaattcaactttcttagaagaaaagaattctaaggaatactgggataaatacatgcacacatatacacacatatgccctgacacacaagacattgtttttaatgtcaagcaagacttccatttgtatatgtttctctacaagctacaaatggaacattaaatatgtcctcagaattaatatggagttacaatagattgtgtttaaagaagctagtttcatgtttctattttaaaccagaggttctcatattaacttcatattttgatagcaagtctttatttaattttatctgccacagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagtaagtggcttttcttttcacttgtcttgccgctattgggtaaatctttctttatagcatcacttctcaaggctgcactttcccattggctgttcatagttgaatataaaagaaagttcttactctatctctgcttcttgatgattttcaatcctgtctactaaataaagggttatggaaatgttgcttgatttacttttccagagggaatattgtgttcaaaataggctagaatgtactcatagggaaaatgtacagcagtaatgactgcacattctcttcctctattttcaaggttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtaaaaaaaataacctcctttcaagaattttcttcaaaatgtttaaataattgtttattatcacatatttgctttactaatgttaacttgtataccatgtataaaaagagctactacaatcagtaagagaaatggatgaaaaacatgaataaatagtttataaatgataaaatacaaatgactgataaacataagaaaatattcccaatttacaaagtatatttctaaatactttcagtaagtatttaaaaacataaattaaaccgacaatatgttttgcctaaaagatgacacagaataataatgtttaatcctggagagattatcaggaagcaaagaagctcatacactgttgataggatgataaattgttatgacttttgggggacaatgtatgaatatctatctattagaatcataaatagttttacctttttacactgtgttatgtaagttctaaaattcttgaatttgtttacagtaagcatatatatttttaaaattagaaaaatacagcaaagatttttaatagttcagtttttgaggaagcattttatttataggacctaaaataatttacttaggtggccttggaaaatctagttagtgcagaaagatcacgtgttcaggagctcactgtgtgggggactagcacacacttcacagttggttaaaagaaaaaaaaaacacacatcacccaaatcctagttcttgatggttaacccgaataactctttgcaataaagaccatatgttattggaaacctatgtatcaggtacagccttagagtctggggctaaaggaattgcataaattattcattcatatactcaaatcttgatttgattatccattggaattacccaaaaagcattattgcttcttcagtatcccatggtgcttcaaagttgtttaaataaccatttaaatccagcataccctgagataacacaaaatcactaggctatccacactgataattgtatttgtttgtagtggaatgaatgagaacaattgcaatctacaagctagctagaaatgattttgagcattatttgctattatggactttggggaacattattctattttattaaaaagtatctctactcatcctgtgtaaattattttatcttctaaataagactatgttgtacagtacagtttgtcttcttttctatattaaagtgtgagtccagtaatttagcttccttttgtgaagattagtgaaacgtagccattttgatcacactgtatggaaaataagtaccaattgcatcttacagtgttagtgacacaggcaagcacatatacagaaccagaacaaacttcccaattggtaaaattcctactcagtcttgaattctgattcctaatagctaactcagttatctcccagcagtcttcactacagatcaattgcccagcccttccaactgcatctgagatatgtgtacattatcagtacccatatttcaaagctaaaaattcagttagtttcttagctagtaatgatcaagtttttaaaaaattatcatctcagttttcaccttaccttataccctttgttgagtgtcctttggtatcaagaacgtcatacatattctgctaaatacattaatgttcaattaaagttaatgccaactttgaacactaccttggaagtgttgttatttccataacctgctagaacactttcttagtaatttcttcttcccagaatatgcaagctctgtatttttgggtgagtattggaacagtgtgtgtttgtgtttgtgtttgtaggcatgtgtgtacatacgtgcctgcttgtgtttgaaaacttgatttaaaattactgacagtaatacaatttttaaaattgaatgttccaggtactgttcaaggaggagacaactttcagatggaaatgtcacaagtgggattcagtgcagattactcttctcaaaatgtgcgtatatcagatagcttcaagccatgttgtcatttggcataacacttccagacacagtagccttatacataaaatgggaagacagccatctagggatcagcccttctgattcctagtcacggtcatttagtttctttgtgctgctgatttacctctaaaatttgaaggttaataatgtcttcccttccctgtttcacagggatcttatatgggggaaaactgatagtataccagaaagtctttgagtaccccagggcacagactgtatattaacttaaggtattattcctgcaggaattttctttgaatcaattaactactggaaatgtttgttaaaaacacgtactcttgtcatcaccgtcatggtcgaattctgaattgtcatagtatctttttctaagagcagacagaaaagagttgaaaaaataaggaggtaggaaaaacgtgaggtggaattggaatacaacactgtcttttcagctcggggaagtctatttctatctctcagaaacatccacctcctgggcccctgattctaatttgagtcaggaggtgagagagatagtgaaaggaggcgaaaaaaaaaagaaagagatcctgggaattatttaaggaacagtaggaaatcccaggatttgatcggcaggtcagaggaccaagaacagcttgttttctatctagaatcaaaggaactgactttttctggatcatcaatccttagagatgctcatagaagttatggatctttccctcagaaaaaatgtaaatgaatctatgcacggagaattttgcacacaatcccatgaggtttttgtacatacgctgaagtcctttcatgcaccccaaatccagagtccctcaatttactacagtcattcacataacttcatggtctcttatcctcaaagtagaacacatcttttccttacttgctatttttcatggcttgtattttttagtccaacatcttatctttggtacgctctaagatagaagaacaaaaaattaaaaatagtgtatctcatcctcaccaaatctgcctcgtttgatgatttatagcattgagtgtttagattgggtttcaagtcaatccagagtaggcatcttcctttgccctccccacagggctgacaaatggttattttccttccaatagattgaatgtcacagctaaagttgcctcttgtagctgtgctattatcaaatagatggaatataggaatatactggaacatttgagaaggggtcaggaagagagaggaagaaagctgaaagtagaacaggtcagaagagggcctcccgagccgtgtctgggatagcagaagtatctccgtctctcccgtgtcagtacttctgtttctcaagcatgtctcatatccggctgtgagctttccttataaatatgtggagtgagagactcacttctgactcctttgtaaagttcataagggtttaccattggcaaatatatgcctttgaaagggaaatttgaagatggctctgtacctgtcctgtactacaggttattacaaaggtttgtctgtataacatatcatactaaataaagtccaaaataacacagccaatgggaaggcttgttctctagcacaaatatattaagacaattctacaatatgtcaatatatgttcatatatatttcatcatttttaataaatctaaacaacttatttcaatgttttgcctaccctgcattcttatgttttaaaggtgatttgtttcaatgatcttcatttttcaattattttaggatattctgatgctgggtgcagtgggagcttttggctggagtgggaccattgtccagaagacatctcatggccatttgatctttcctaaacaagcctttgaccaaattctgcaggacagaaatcacagttcatatttaggtaaggcatggtaataattggctcagcaaacttaagttcccttgctttaaaccagctctttgttgaatctcagggtgagttcagcaaaatccttgaactgtcatctaattatcatatttattacacatacatatgttgtctctttgccaatcgggccttaaggcataactacttattggaatactatattatactcactagtttcttctggctggtcaagtggttgtaattcctggaacatgattgtgttcctccaaaatggaaatagttcccaaaagtcaatacagtaagtgatagtcttatagtattttagagctcttagtcttcttgttcttataataagcagccactgattttgcagacttactatgggacagttcctgagctgctagtctatctacataaacatttaaatctttccaacaagtctttcagggatgttttgcctttgagagatagcaagattaacaacttgtctaacgttcaacaacctagtaagcggcaaatccagaatctgaacctcagcctgtttccaagacctgtgttctttctactgtgcaacactaccttttaaatacatttattcattcgttcaagaaatattttttgaatgccaggttcacaggtggctgatgagaacagcgtgaaatctagaggcagttttataggtagaagtcccacctgcaaagggaagtgctgcaggtcaaaggacaggagcaattcatcttagaaaaaggaagacatgtcctcagtgatgtattcaggagcactagaaactttgcatcacatctaacacaaaaggatctctggtcacctttactcacttcttttaactttattttgctcagatagtcaatgttaatcactctgttgctccttcccttttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccaggtaaatctcactgtttagcaggtgaaattaattttaggggcaactgggcaggtggggagtcaggtgaacagaaatggaaaacaacatggcctgagtgcctactctgtgattggctctgtaatctgagtttacttagtgtattccttaaatcatcacaacaataccaagaagacagccctcccttttgacaacttactgggaatttagctagctttctaaggtcacacagcgtccatggattgagctgtcattaaaactcagtcctttctggactcagaggctgtcctgaatgattacatccccttcatgtttttgactccctggattaataatgcatggatattatttagttgtgatggcaggcatgtaaccactgctttgtaggtaagcacacactaggaacaaggatttggagaggaaataatgagaagaagggagcagcacaacattataaggactgaacttttacatctgaacctgtcagaatgtcctgttggttttgaagattctaaaagtaaaacaattatcttctctgccactttcagctgatgggtgacagtttggtagttagaccctatgatgaatcccagatatggcccactacagcaaagatctgttgctagagcaaaggccagctgattgcttcctgtttccttactaaacagttttgacccaggggcttgacacacatttaaaatgagcatcactaatccctgacaaccaacaaaaagtggtttccttctttaagctggagaaacttacaaagatttctcttctctgagattaagtgtgatcctgctgttcctatggattttctaggagtaagaagacccgagttcttgacttccgtgaccacaaattagctatggtcacatacttttctctcttttttaatattttaaagaagttcttctttaatttagaaaataacagtgacagtgttatggaaggaatcatttcttagtcatttctaaatcctcaaaaagtgttcacataggcatgcattgaacgttgttgaatgggatgaaggttcaaagtctcagcttttcttattttaatttatctccaccttgtcctcctgtcccaatctatccagcaactacttacctgtctcatatcatgccatgtacacttacatcatcatatgtgctttcccacttccctctgcctagaaaactccatgtccttcttactttgcaatttgaatgatattttaactttctaagccttcctgactctcctgctctctgatcactcagcctttgggacttgcctctattacaatttattttactatagaagcttaattatttattctccctgcctctacccctcctgccttttgctatgacaaacctcacatacctacaaaaggtttgccttataagtatgtctttgaccccctggcatcagaaacacctggaatgctaatttaaattgctgtgttctggatcacatcctagacattacttcagaatctctagaaatgggtctcagggatctgtatttcaaaggcattttcttggagattcttgtgcacactaagatttaagaaccaggtgttagatggtgttagaacctgagggaaggaactgtgctctctgtcttcatgttccaagcactttgcaaatagtaaacactcaatttttgtgtattgaatgagcaagtaaatgttcagtgtaatattagaagtatatgaatcctaggaattctaagtttaacatgttttattactccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagaggtaaaaaaaaaaaaataaactaatagtttaatttgctttagtactggtaatttaacttgcatttggaaagaaaaatttattattattgaatgataatttgcacagatagtatggtttacatttcatcatttttgaggatgtccccattaagttatgattttaaaaatcacattaacaggaaaaactagagttgaatgtatagtgtactgccattttccatgagaggtctttgaatatatagtctcttatgcaaataaagccattataagtgcacatcgtttattgaaatatgcacacacacaaacatttgtgtatttctctagtatcacatgtaattttttgcgataaagacaacaataacagggcaatgctttcttgttatcagttgacagtgaaaaacagaagttttaccaagcactttgtaaattccttgtgatctcagatgcttcctacattagtttgtcaggaagtgtcattgcttagtgtaacatttaggcatgtatccaactcttgaagtttcaagtccttccacaaaaaaacaccatacattaacatggcaaagcataatttttccaatttgtggactgaactctctaaatccatgtatataagtgtagtgaactccatgaaataaaaaaagaaaaccaaattaaaggcacagattgacatagaaaattatatgctccttagtatataagaaaaggagaagctgatgttaaaatagtaaatactatgtttaagtattgtgatattttgtaccaacctgatttattgatatttatgtaaaaattaatcttttaacagaagtaattaattaaaacaattctaaagcaattatacatataaagaatgtgtaattgagtatcaacaaaggctggacctagttacttgttgaaaaactgacaaatccccccttctttaaatatttcttacttgtgagatatactgaattatcattaattgttgaaaatgaacagatcttttaataccgtgtcaaacgcagtaaaaatttgtataagattatattagaggagaaagaacactgacccagtttcatggttgagaaacattgctttcttgtgaagtcatgaaatatttccatacttgatcataaaattgaagaaaaaaactgtgttttacaaggaaacgtcttttcctttgcacagaattatttaatgtttttaataatggagatattaacaatctcattttctacttcctgtaccactataattatgtcactatttggtaatttttacagaaagcctaaattaagatattgtgttttattttgttctgtgtctgctttaatttcattcaagatattagtaattttcaccagaaaaattttaaatcaaaaggttggaaatagatgaagatcgtattattgagaggaaaatgagaccaagaaatggatgctgttcagctacagtaaagagaattatctcctttgaccttggtttatgagcagatatttatgaccttactgaaattcttatttataattctgatcataaatagttcaggtttaaaattctatccatttttaatattaaaaaattagtttggtcatcgattgctctgaattttattttcttttttattttatcatatttctttcacttttttaaatagatggggacttgctctgtcacccaggctgtagtgcactggtgtgatcatagctcactgcagcctctaattcctaggctcaagcaatcctcccacttcagcctcctgagagctaggactacagctgtgtgccaccactcctggctaactttttacaaaaatgttttatagagacaaggtctcactattgctcaagcaggtctcaaatacctggcttcaagtagtccttctgcctcagcctctggagtctttgggattacaggcatgagccaccacacccagctgctctgaattttaattatacaagttgtaaggtttgctttaatcatccttttgtttcccctttgcaagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccaggtaatccatgagctgttatggtgatgtatgtatttgtgggtcttatcatattagacatagaaagcgtcatgtaaaccatgcaatccgtccgccttattttgtaacttcattctttcactcagcaaatataaagtgagcctctactgtgtgcccaagcactgttctagagtctggggatgctataagaacaggacagacacaattctgatctttgtgtgccttatattatattggaggagacaaataaaaagaaagaagtagataagataaagtgttccagatagtaataaaggaatttttaaaaaagcaaatgaaactaaaataggaaataaaatttcagcaataggagtatcaggtggttgaaggggtgactaatgaggcctcactgagcagccaattttggagtaagactggaaggaaaagaactaggaaattaaccctgtacctgaacttgcatcaatttgctccaagtccactgatcttttcactggtttatgattttttattaaagatttatgctgtcccttcgatgaaaatgtggctgtaagagtgatgcagagatcagataataagatgtgattaaaaaatgaatctttagaatttgtagagaataaacacaatctgggacattactatatagaaaatataataatgaaattcagaggctgccattttctggttcagctgttgtgtactataatttcgtgtcaaacctgctcttttagaaaatcttgggatccgatggagcctttaggagccatctccagtactttgggaggtccttggatggctatggagatttaaatggggattccatcaccgatgtgtctattggtgcctttggacaagtggttcaactctggtgagtcaggaagagccagacacaaactaactaaaaattacctgctaagaaagcagaacagatgtctgtactggtattatagaaatgccacatgcattctataagactatagggaatcgatgtatcatagtttgcacaaaggaataaatgtgtttttccaagtaggaaaaatagatatatttgcttaccattagaaatatagttctctcctcatatggtgagtaaaacagtacatagaaaacataaagttctggaaatggtatccaggctatttctgaatgttatcttcctataaatagccttatctcagcatacagaagggaaacctcatgagagtgcattcaaaaatactgaaaattcagaccacacaagtaaagtgtaacttctatgtgactgaatggtatattttaaaattattagtcataaacaataagccattatttaggtttagctgacctctcattgacctccacaggagttgaagattcagagagaacagtgtgaaggtcatgtgattcaaggtcaaaaataagtatattgggccggcaagggaatagaatcagaaagaagttgtttattcaatcaagaatctccattcatttgtctctgtcaaaaaatgtgctttaaatgtacaaatatttgaagaacagaaaaataatattcattgattattttttatttctgagtttaatgatactatttacaaatctcacttgtgcttttaaagaatgaagtacattatttttattgcagaatgaaacttttatgtggaaaaaataaaactcaagaataatacttaagactttaaaaaaacaagaaaatatatttactgaataaatcagttaaaatcatttcagagtagcatatcaagagtaaatacacatatcccagaacctaaagtataataaataactaatatgttaaacatgtattgtgttagtgatgcagtcacaaattaaaaaaaaaattatctctgtctgccatcttagagctttcaaatatatactactgctaaagtgctttgatagagagtagagagaaaaattcagtaatgctggtactgggtcctctatgataaaggatataatacgtgtgctcagtaataacatccatccatctgttactctttatgtcttttaggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtgggtgcgtagatctgaaataatctgtatagaaattggttggcttacagagttttagtcctgaatataacatattttggtttgtaggccaagagaaataagggttttagttatagacacttaagtttccttacactggagatgcccgagaatggttcactagtcatggaagatttgtttagatcttccttccacatctctagaaggttctgctgcagaaagttgtaatctctatgacataaccaagggccctcctgcttccatcctttgagtttctcttacctccatttctcttacttaaaaccttgagcatacacagattatgctgaactgccactcaaatgactatatcatgttggctatgccatgatctatataggacaggttcagtaaaagtatcaagtatttttcctgttgttgaggaattaataaacatgaaataatgaaagaaaacatgaaaagcaatatataacttttacccagtgttttaaatgttctaaataatacagagaaatgagtaaaagtctgaattatgtctcatcagatggggaaggatgaggaaatcattgtgggcaagcatcagcaggaattgttgtcttttctcttgggctggccaagttgtctttcaaggcctggcagaggtcctgcctcctcttcaaagctttttctaagcacactatctcaccttcatctcttctgccccaattatctcaccatgctcaatgcatagcttgcaatttaacacttgattcaaagctaccttctttcattaactgctgcttcatgggtcccaattcccattccgtcagaatttggctttaaacttcagaacttgtagttcctataggaattcaattaagtgacaaacatattaacttaaagctgaaaatacagaagcaggttatttgccataattcataccaagatacaaataagatgagaacacaaagcaaaattagattcaaatcttaacatgctttccatattttcctacttttcatatccatttggaagttttccatgcagatgttcaaagattgacccaattttgagtagcatatgtcacttgacctgccatgtagcacatctaactgagcacacatgatagttaagtcaaaaaccgttgctgcataaacattgtggctagtctgcctaataggttaacttgggaaatatattatttggcagaaacagcaaactggtcagctcttctggccccgaagcatagaggtgtctcatgtatcttccctttttgactatacttcaacccttatggtgatgcacactcaaaaattctactttcagagaatttccttcccatccacaggctgccgagggtttctggcctttcttactattgggcatctttccctttaaatcttttttcctgatgccttcaggtccacaaagacaagccaagtgaaatgattgtgagctcatttgtcacttcattgcttggcaataatagtatgtaagacgtgaatcccatcttcacaactgtggaaagtgaatttataaagcatatggtttctatcatttattgcatcaggtgcacacttcactttaagattaataacatagcccatgaagcgatgtatcatttttataaagctgcttgaaaaaaaaaggaaaagcattataatgtggactaactttgtcctaactgcactcacctccttgccattgtttttcctttacatcatcttcacaacttatttttagtttatttaattctttaatattttatctatctttgttggcattgttaagtcactggagcaagaaaaattgtacaacatatatgatagatttttttcaaggtaacatgtagaattcatgttttgggaagtatatacaacctttaaaatattgaaaataataaagtaagatagaataaccccaaataaggcaataaggcagctgatgctgtgaatggcaccaggtgttctctctcaattttggacacacggccagtggactttagttgaaggtaataattctgatagtttagacatcggctactgacatcagttattatcacataattttttttcatgagttggtattaggaaacagaggttcaaagagggtaagtaaattgccccaagtcacagagctcataaacagcagaattaggattcaaaccaagtctgcctgactgagactttattgctgcagtgttgcatgcatttccctatgtgagcatctagaataggtcaagcactgtccatgttcccttagagtatctcagttaatcttcacaataacaattaattcttacaactggatggaagcagaaagaatatgagctcttatttcaaaaatacccaacttttacttctgactagccatgtgaacttaggtgaattattttacatcacttattctagtacattatttgaaaaataagataataaaattcactttccagattcattgtaaaacttgtatggcatacatgagaatgtgtccagttgcaggcgctcagcaactgttcctttccattctgtgtctccgtgttatgagtaatgaaacccgtgcttgtgggagtgagcaatttgcccaggttcatcacagtaggtttcctggcggcaagtctagtttcctttccactgctcccagccacatttctctgaatcacatttctttgtatgcacagtcacctacgtcacatcagagctagaatgacaaatgctttgtggtgctagctatggttcacaagccaccaatatgaagactatttccatattttcttgatgtgagatactttgtccaagaagacacaataaagcaaagatgctttttcctataagttgatttgaaataacatttctttatgattttttttatcatagccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggtaaggcctcaggaacatcccttttgactttatttcttcctaaagacaagagagtggtaaaagtcaaaaatggaagcttatgagttagaaaatgctcacccttccaatgaatgcctttcttatgtaattccataaataagaagcatatttactttatgctaatatttatggtcacaatctattatataagtcagcaacatcaaatttcatttagaattgcaatgaaagggctaaaaatacaattcttaaagaaatcatagatacagtgttttcttaaatgtttaacagagagaactttccattggcaataaatgttattttgatattttcctatcagggaaaaattttatttattgttcagctactgaaaaataactccaattgtggtttctactattagatttaagttaacatagatgaaatatagtagattatgagataacaattatttgttctaatcgtatgctgtaattactgtatttaacatggattttgaaaatttcccaagtgagaaaaatgcttttcaggagaaaacttccagccggaaatttattttataaatgatgtgaatatttccaccttggaaaccacataatggcatttgaaaggataatttactcaggaaatcactttttttaaaaggatatttaagtactttcttagaatacagttctcagaatttaaggtgcgaaagaactgccagggaaacttttgggaaatgtatattctgggttcttaccatcagaaatctaggtttgaaggcccaaggaatatgcagatctaaggagcaacccaaatatttctgatgtaaatggatggtacagagagatcttacttcaagaaatgctaagtgtaaacactagaaaaacataaagttgacggttagatgaattaaaatcagttgagttgtttagttcatttttcaatttgaaggtttcttgtttgtgaagacgtagacttcttttttgttaaagtgacaattttatagattccttaaaggaaaaaatcttatttcccttctctcccatcctgtgctgactggtggatcagattatacatgcaatccctagtgaggaaatggagacagccaagctgtttttctttaaagtttaaaaaaacaaaatcctttttcactatttgatatcaatgccagttaaagtacatcctacttgctaagcccgcagccagccaaggaaacatctcctcatagtccagagctgtcatggtagacaggcccccagaaggaataagtccttctgggaggacttctgggaggcccccaagagttaagagtaagtcctgcctgtgaatggactaaagaataccaagataccgcttctgaggaaaaggcaaattcaaatgttagggtttcatttgtatagacatagtgcttttttgacaagaactgatgagcttaactaagaatccctgcttcaaattcttactagacccaagtctcttttggtttcttagtagaagagaggctaaaagcagaattaggatggaagaaaagaagcgagagtcttgattattcacaacaaagatattctacataattgagagctgactgtgctcttaattgtaaacacatttggaatcattttcttgttttaatgttgctatgctctaataaactgactctgtctccccctgtatgtttgtgtgtgtgtatgtttaggagccctctgatgttgtcaactctttggatttgcgtgtggacatcagtctggaaaaccctggcactagccctgcccttgaagcctattctgagactgccaaggtcttcagtgtaagtgcagcttacacttcctggatttagactggcaaataaagttccacagtcactgcaatagtgtctgaaggatggttaggatgcagcctgaaaattcttaattttctaaatgaactacaattacatatgcataaagttcactaacacttaagttccatgacagcagggatttttgtctttcttgttcactgctgtgtttccactccctagagcagggcctggcccattgtatgtgttcaatatatatttgttgaataaataaataaaaataaagtaaatgccttgtgctcatactcaaaaaatattaccaatacatatgaagctctgcgtatagctgtccccgccatagacactttcatctagctccccctgtgcaaatgattatcttgaattgtgtgtttattaatgcttttctttattattttgttaaacatttatatattcctagaacattgtttggttttgtactttatgtaaatagaataatattctatgtattcttctgtaatttgctttttcaacccaagagcaaatgtatggatcttttttcctttttcgtagattcctttccacaaagactgtggtgaggacggactttgcatttctgatctagtcctagatgtccgacaaataccagctgctcagtaagttttactttaaagcttgttgtaaaatgtagaaataaaagacatactagattactttattcaaacgaatgtttatagagtttttctacaaaagaaacattcataactcataaatacctttaaaaactaaatttcaatgtctaccatccacataggagtaaaacaataagaaatataaaattatctgtatttaaatggttccattccctctaatacaatagcaacaaagaacaatccaattgcatttacttatttgttgtcagtatcattttgatgcaaagatagtttattacacagcaattttctcagtattctaagtaagtctaaagagtttagttttttaatgagtgaaattttaaaatactggcctttttatttaacagtaatggcttttcccccctcctttttacttttaacagagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggtatgtgatgagaccctgtacttacttccaccatgcttcctacttatagatcactgtcttctctatgtcctctgagttgtttaaagaagcaccttaaccctcaacatgatcaatctgaactttgtggcttccgactagttaaactgcatgagaacatagtctggctctatatctagattctgcttgacagcttgggtcagtttttcccttatcctgagacttggcagcagtagccagacactcccataactcttcttgagctatcagtgtgatgaggctgctgcattctgcacagatgtggtgcacttgctctgagacatttgagtcccaaagcttagcctgagctttgcaactatggttgttgctgctgccaagatgatgcacgccagcaaagccaactaatcacattgacttgatcattataccaggagcacacttgactgtgagtgctccctggtccctcctctaccaccaaattatgaagaaaaaagggagagaaggaaaagctgagattttccaaatgagctatctgattaaaggattaaacaatgatttcatttaatttagagttaatgtgatcttaataggcttagagttctaaacctaacctgaccttggtgtttaaacaccctgtgccaagtggcaactacttcctttaaagggaaaaaaaaacctgaagaaaactaaaaaaaaaaaaaaacaaaaaaccctcaaattacttaaaatacagacaaacaccaacatatgattttactttcttctcttgaaaatgcttcaaataaattgagaagaacatattcctaaagccagcatttcaaaatattgaattaaagctattcgtgcatctgaaaataaaaactatcatttttttctggggaaaaaatacagtatttaatcttttctttgttttgttggatgttctaggtatctttagggttagcaataaaagtagtatattagccacctgggcagtataaaatttcaagtcttgaggtataataaattatttcagtatgaaccaaccttactgctaaaatgccactgtacctcttttaccaggtgcgtgcatacacacacaaatgttgtatgccaattgatcattgttgtttccttggtcttgttcaggttgatgggacagaagtaacatgccaggtggctgcatctcagaagtctgttgcctgcgatgtaggctaccctgctttaaagagagaacaacaggtacaacttgcatttcatcctccaatccatacaagccctccttagcacatatgctaatttaccaacataacatcttgctatcatgatttgataggcatcacaaaataactagctgcatacttaggggaagttttcaatatctaaatgttttctttaaattattaataaaaatgggattttctccatgcaattcattccaaaaggtacacatactatggaaagttctttttgtctaaatatgttgagcaacattggtcaaagcactatacacagagtcacagagatcatttattaacccctagtaacaagtttcacatcagctcaaagcttccaaattcagacaggtatatacgcctggataacttacatgtgtcacttggaagtcaagcttctctaattctaatgtgaggcatagtaaaacaaggtggacaaataaagatattccacaaatttgaaagcttaaggtatataaaattcagaatcaaatttgagtgagtttacttttatgagaaacattttttttttcacgttggcctctgagtatgaagcatcatagactgagaaattttaattttgtctttaggtgacttttactattaactttgacttcaatcttcaaaaccttcagaatcaggcgtctctcagtttccaagccttaaggtaaaacataatgaagtcatgaatggaatgatggatagctttgtatttctctttaagtaatttcctaatgtttctttctatagtgaaagccaagaagaaaacaaggctgataatttggtcaacctcaaaattcctctcctgtatgatgctgaaattcacttaacaaggtaggtgaagcagtgggtaacctgctatcactgacaccaactctagatcagaagatttttggctcatggctaaagaagtcctctgtatgctcattcttaactgaagaatttgaattaaaattcttgtcaactaaaacaggagtccacagacatattggtccctaggaaaaccttgagtgactcgttaggcttattaaaccaatgagagtagcccagaaaggcagagaaagatccccgtagccacacatcacaggcacactccacattgcaggccctctgagtagctgcaaacattctcaaaatgttgaaacagaactctcaaaggtcctgagagttgtcttcactttcttctcactgcctacttcccattgtatgtgagatctcaagcagtatccccattcctggacattgaagccccaagcacaatgttttgcacagagtaggtccacaataaatattgaatctagtcactgtttgaatattcaaatattggaactagatcaagtctagtttctgagggaaaaattcctcacatatcagattagggttttcttccagccaggtggaaatgaggttttttccaaaggatgttatccataaagaaatgctttgttccctgtttttacctgcccaaagcaagcaaacctgagagcagtggtgtaaatgtcactggttgatacaggctgtctttaattgttcagagggacaggtgtcttggtaagtgggtaacacacaaattccacaggttctaataggtcgatatcactttaactcacacttagaagtaaggtgagttcatggcacagacaaactggaacacagttgtgcagatgcactgggcacaggtgatgccctcctacaggcctgggaaccagagttctctacctggtgaagcaataggacagcttcccagcacagatcaatgacccctgaatagcacactgcagcactttcccaagaaatccagtgacagcaggtttgtctaacttctaccacatcactccagcccctaagagcatggaatctgtagatcatccaatagctctctgagcaaaaacaaaaaggaaaatatgtcatcatgtctagagcttgagccaaacagcaaagatgaaaagaatgcttctgtatcaagtgagttgcaaatagcacaagcagaaacaaaattccgtccaaataatacatctctgaaaaagtcatcagtaactgcagacttcaaaggatccccacttgctaaaataagaaattggaaacaaatgcaaccaacccaaattgatgttaccacattacctgaattttttccttcttatatttgatcctttcttctaaatattttttgtcaatacagtctttttattattctactctcctacaatggccaatattttcccagatatttaagaatgaaataaatataagattgaaatgagactttacttttactaattatcatcttaggcaggtatttttgtaatggcaacttgaattcaaatgtattctaatgttctttaaaatatatcctcaaaaaaattaacgtagggaattataaagaacaaaagttaaaatgggtcctagtcctactacctagaaaacccaaacattggagaaaggtagacagtgagaagtcatccctccccaccttccctagtgccactccccataagagactgttttcagaatatcttccagatacagggttgcttatctaccaggatatatgcatgtaacacacacatacacatatatatacacacacatgtgcacattttattacccaaaaggaatgataaaacactcttctgtaccttgcattttacataatcttagaaaagttttcatatgaggacatacagatctaacttattccagtcctggctggatcataatttatgtaaccaattcaatattaacaagacatttggttgttttgcatttttattttgttttgtttaaccatcataagcaatgctgcaaaaaaaataacaaacatctttgcaaacttttggaaaaaatcctacacaataacttagtgtatttcttagcaacaactttgatactgtataactgtacagttatattgtaaaaaaaatgatgggtagaaatagcgataatagtattatttctgaagcaggatccccctgagtatagatatttactattataaatatattgatcaacacttaagtaacaaatggaaaagtgtcagatctctttaaaatgcaaatgcagaccatattaatttagaaattggccccatttaggatctcacacaaagatcttctggaaggcataggaaataattcatgcacacacatccaagctttctgtttcaaatcctagtcagttttcccattttccatgtcaggctgacaaatcattgtttcctctcatatataaccttgacaaatacatccactcaagtctccctgtgacatattttccttttaaggatatggaaaaaatcattaaggcataaaagagggaaagacaaggttttagtaaagaaacccaaaaaattctacttcagaaaatatccaccccaagtttttaagaaatagaatcaacattctataattaacgtaaattgtccagtgggaataaatggaaaggatatgcacagtgttctcagacccctaccctcactgctcatcccctaatcccccacgcaaagaagctaccctggttggaatcccacctcagagccccagaaatgagtgaggagaggggaggtccccagtttcattctagtctgagtggtcctatgagggtttctctgatctcatcatcactttgcttgcagaacttagttggcaatcttaagcaaagaagttaagatcaatccagtggctttaggtccagaatactaaaacctctggatcatccatcttaaaggtggtctctacactaatggtggaaacagatttgaccaacctcattcagacccaaaccattcaaattggtttgcaactaaagaaggataggaagaacgaataatacaggcatccaataatgaacactgaaggagctcaataccctattattatattttagccacaccaaagtgaaaacccctggcttataaatccattcattcaactaacaagtactgattgtctactatgttaacatactagtcaatataacagtaatcttgggaagacttctactatcaattctaaagtaatacttttgtacttatttagaaacttgagaattggtagacatgtaatgcacaaactcttagcagaaaatccacaaagaaatatgttttcaaaggaatttatgttagtcttagaaacatacattggacgataagcccataggcaagcatttctttttatttggtgcttttgtaactaaaagtaaaatttactttaacctaagctataagatacttaaataaaagaaatattaaccttcaagaacaaaagcaaactaaaatatttggctttacaaacatcatccaacagatctaccaacataaatttttatgaaatctcttcggatgggaatgttccttcaatcgtgcacagttttgaagatgttggtccaaaattcatcttctccctgaaggttggtaagcctgtcataaggatggcaaatccaggagaaagtgagaagaaaaaaaatgagtctggaaataaaaggagaaagtaaaaagaaattgaaagagatccgtggttctcaaacttgggtgtgcattacaatcacctggaggaattgtgaaaccacagatgctgggctttatctccagcgtttctgattcagtaggtctagggtgggcctacacatttgcatatctaacaagctcccaggtgatgcttatgctgctggtccaggtgccatactttgataaccaataggctagatcatagttaagtaaacaactgggctttgtgcatagttatgtgtcttgggtaagggatacttgatatattttgaaggcaaatgttcaacattaaccaacagagcattactataaaggaaggtattgctgtgggtaaaagtctttggcatataattattatgccaatttatcctcagagaccacttctgtttgagtttaccatttgtatacaaatctgtacagtaatactaggtagtatctaaaaatatttttgaaccaaattctatttactattagtaagcgattattaatctaaagattactaccagttaaagataaattaatttgtgaaagaataactattttatattgtaattaaagttaaagaaactttggaaagtaaaaagaatttatccactatcctaagccaataccattttatttttgttcatttctcacttgtttgttacatggttgcaactctgcaattttgtgataaaaaaaatctttagaagaatctttatgatctagatactacaatagaatttataaaatgtggatggtatttggcaactacattctttaatggggcatctattcaattcgcggtaataacattcatagagtgtgtaataagtatacaccagccatggtatcaagtgctttacatatgttatcccatttagttcccagatcggttatgagcttggtattattattcccagggatgttatttaaaatatttaaataaccagtagtgtatgagccctggccaattagaacagaaacccccacccatgagaacagatgctgtaccagtgccctgtgccagcacatacatactgaatttctgatcatctttattttacaaataagaaaagcatagagaggtcaagttccttgcccaagccacactgctaatcagcagcagactgggacacaacactccggcagcccagctccacagatggcatttttaaccatttataccacatgtctcacaaagtcacaaattacttacccattaacattgtagatgttgagtttttttccattgagccatttatgcccagtgttccattattggcgcactaagcatgtgggagttacttatatcctactgctcaaggtcattgccaaggtatgatcgaaatttcaaaaaaattgcaacctcaggcataaatgcgttttaagaggtgagacacagagacctgaagtgtgactataaagtaatggctgactttcatttggactcagtcttaccacctcgtagttgcccttcatcaacacggggttactggtgaatttccttgcatcatgtacatcctgttgcagtactggcacattttattctctacataggtaacaacaggaagtgttccagtaagcatggcaactgtaatcatccacatccctcagtataccaaagaaaagaacccactgatgtacctaactggggtgcaaacagacaaggtaaagattaaaaaattgcctaaaaatgtgtactttcaagatgtaaataacccatgagattagggtgatcatgtctgacattttacagatgggaaacagatggtaactcctatgcagcctgggtgccaactgactagcagttaatttcatattagaaaaaatattgttacaagaaaacaaatggctgagtctagggaattgcaggtggcagaaattattccaaaaaccccattttggcctggtgaagatctgactttgacaggccctgtgaaggctgggaggtaaggggctggacctatatggggagcatagcaggtcttcacagctgtgataaggagctggtcttcaagcagccagcctggactttcgcctggtaatactcaaccctggctgttcattttaatccctctgttcgctcttttaaataacagtgcccagacctaacccaggcaattaaatcagaatctctaggggtaagattcttacaccagagtttttctttaaccacccccactccatccacaccatggttctaacacgcaacctgggctgagaagcgctgctctagccaaacctcttgacattggctcatcttcagtccaacagttgtattattcaacagttgtattatttctgtagtgtgcataggaggctacagaaaaatcaaaatcctaaaatgttccagagaaaattaccctgaattattcacagtgtttagctattgcagatttgcctcatcatatgtgggctataaaaacctagcccacctcatcagttcacatcaggagcatttaaatacttgatgttcacctagagattatatgaagtgtggccaggtcagtggcgttgaaagaagcctaacagcccttcccagacccctacaagtgacagtaggatttcctaacatgttgaaaggaacatcataaactgttttgcttctgaagtctgatcgggtgttcttcttttataggctggtgacatcagttgtaatgcagatatcaatccactgaaaataggacaaacatcttcttctgtatctttcaaaagtgaaaatttcaggcacaccaaagaattggtgaggacaagttaacgtgtgaaagctcccctcattcatttatttcacctgtgatcaggacgctgcttttctcctaccagctgatatcatagagctttcttattttgcctttgatgcttatatgagtcaagatttagaaaatattaggttggtgcaaaagtaaatacgattttgaaacccacaatttacgtttgcaccaacctaatatgtggtcaaatctaggttactggaattatcttatgccacttcttacaaaatataagttccagactttatgacatcagaaaaactcatgtgaagctattgtgtttatgcgttgtgcactttggaaacaaggcaaagagctgtgaaggaactagctgtgtgctacagaggagaagccccttaaatcccccttccacataatactgatgttttttatttagctgtgaaatatgctgctgcacttctctgtttttcaatattttgttatttcctgttctcaagctatgcctgcttctttgggaaagagactagtctagcatctggcatggtgctcggcacatattaaatattcaaataaagtaaacctttagtaagcaataactcctaaacaaacctcagctctcccctatgaacaatattggaattctcctggttttctttaattgcagttgttttattttgtgaaggatggggaaaacaggaaaccagaagaataaaattatttcttttaatgtgtattaatctacaagtaggtaaatgcatgctgtaactgaagtgggccacgctaccttttggccttgaacataggccaatgtgtcatagattttcaattaatgacttcattttttaatgcagttttacattcatggaagaattgagtggaaagtacagaagttcccatataccccctgtcccacacagcctcccccactatcaaaatcccgcacaagagtggtatatttgccacaatcgatgaaactacattactatatcattatcaaccaaaatccatagtttacattagggttcactcttggtgttgttaaaatccacgctgtggaatttgacaaatgtaaaatgacatgtatccaccactatagtatcatacagtgtatattcactgccctacacatcatatgtgctctgcttattcatcctgcccgccccactagcccttggaaccactgatcctttttctgtcaacttgtttaaaaacctagggagtctataattaggtttaatgacaaattgtagtacattttgtgcatgtttactaatttatttaactagtacattgttgctaaacaagttacagttttggggggggttggtttttaggttttttttactcttagaaatagtagtgcaataaacaggcttggggtactttgttccacatattgctgattatctcctgaggctatctatacagacaggaaatggatggggtaaagagtgtgcacttggtacattttgagatatagtcccacaatcccttgaaggagggcgggagagttagaactactaatagctcatgagattgcctgtttccctaggtgtgtcccagcactgagttttatctagctttaaaattttagcatttattttttaactcttactaacttgctctctcttttacctttgactcaatactataagaactgcagaactgcttcctgtagtaatgttacctgctggttgaaagacgttcacatgaaaggagaatactttgttaatgtgactaccagaatttggaacgggactttcgcatcagtaagtatcagttttatttgttagatttatcaatagcaaggaaacataagtctgcactgacaagttcttcccctttgacaaaataagtattctggctaatgtctgcaatggccaaataacccagagcattttaccctgaaaggcagcacacttccatcgctttccaatgcccatccaatttagcagtgcctcagagtcatctgggatacttgtgaaagggtctgtttctcagactccatgcgacctaccacatcaatgggaatggtgtcagggtcatctctgcggccctgggctacaaggggcagcctgctttgtccccctctaggggttcctccactctccatcttcccagtctcctgtgccacacccaaatcaaaatgtctgtgtctctgtctcactccttgagctctcagttaattgtatgattgatctcaaaccacctagtagatgaatctagcataaagatatgtcttcctatattacagccaggtcatcaccctgctctcctgttttacccttttcctgttgggagagcccagtgggcacatgactttctaaatcatctcaatccccatgaaagtttgaagaaaaagccaaaacaatgtcattgtttttttccatatggcaactgtgagtctgctctagttatatttgctttcagcagggattttggtagctagaatttcagtctggcatgaaaaaatataaggatagacaggcctccttaaactggactgcttgtgtggctagcattccttttactgacatgggctccaattgaggaagaaaaacagaaattagtctgaaacctcctggggatctttgtagctcttactagatttttttttttctttttaacaaataaatcagttcccaaggtgcttacaaccaaacgctactcatttttttttctgtttatcatttcatgatctctccaataaatccacttcctgctatagagttttgtaaaactggagaactcagcaccctccaaactcatccctggagtcaaatataagcaatattcttggacaaagacatagaagaaaacggaatagtaaaagttagaacaaaatgcagaattgggggaatggggaagtgaggagttgaatatttcttctggcttgcttgcttgcttttactttgttttcttgttagttgcatttgctttcaagtcttcaggacaattctaggtcctttaagacgtgaagcgtgccgttagttgttatcaccttcccagctgctgcagtgtggtgctcagttttgctccattggttcttggctccttggatttgaggaacaaatgttttcatagcaaattttgccaactggaaggaacactgactgttgcacatcaaaatgcacacatgccagctctgtaaaacacatttggattttcttgagtttaagactacatcactttaactgtgaaactttttaaagtaccttcccaacgatcttcagaagcagtttatttctgggagtaaacttcctagaaagtgtagtatttatgctgctttaatgtggctatggtggttaaactaagaaaacacccttgagatgtcaaggtatgtcaagtgacatacaaggattgtgtcaagtcctacatatcttcctccttcatgaaaagtcaaatgtttatcctcaccttgcttccagcaatttaagcagcaaagtggatgtttctcagaccacttaggagatccagtctgaaatatggatctcatttcctgtatttgaacccattaatgcactgccttttgttgctaccctttctctgatgtagtgcaaggcaacttaacatttcaagtaatttcattacaaagtgattgatcagggctccaaattgatgatagagttgctgccatttgtagggagaagccttgttgaacgctagcaggtgcgttacttcactctccagatgtgtgtggcatgcttacctctacttgttaaccctgcaggatattgtatgcctgtgagaagggcctattttgagaatgctataagaaaaattctttcatctttagtctttggggattatgaaaccagcatttacttaactgctgctttttttcttaaacttaaaccattatcaatactcttaatgtttcccccaataatatgtttaagagactggtgagcatggttaatttctgatccaatcatctatattgagaaaattaacagtaaccagagactgagccagtggaaaggaaataaattgctcagtttttggaaatacattctttctggctcccagatattgtttagcaaattacctcacagagtatgtccaataatgtgccctagtaaccagaaaaactgagtcctagtagccacagcatgtgaaagcagctctaacatctaagcgctgcattccgcttcacagtagcatcagacctaatgtagagaaaatagtgaaatatacacatcaataatgtttctattgaaaaaatagacttttttttttcccccagacagagccttgctctgttgcccaggctggagtgcagtggcttgatctcagctcactgcaacctgtgcctcctgggttcaagtgattctcctgcctcagccgagtcgctgggattacaggtgcccaccaccatgcccggctaattttttatattttttagtagagtcagggttttgccatattgaccaggctggtcttgaactcctgacctcaagtaatctacccacctcagcctcccaaagcgctgggattacagatagaagccactgtgccctgctgaaaactaggctctttttctgtaactagatggaggaatgaatgtaaagttatttcgaattagtaagttaccagtgacatcagcataaaatatccttcctatatacctgccccaaattaagtattatttgatagaaacacttagataggaaatctgaagttatactgatgtgatataacaagctgaaaggttcagggccatgggtggtcaagttcaagtgcacttttaaacactatcattttacacacatgtacccagaaggaaagttctcttaccttttaaatgttggttttccattccattgtgtgacttattcaggtaagtatacaaagatgccaagtttacaattttctctcatgtcacaaacttattttttaaaaaatctgaactgtgatcttcccagttagaaatattcatttttaaatcctcacttttcaacccagttctcaagttcagatctcctcagggagatattttaacctactcatgtctggatcccaccccagagagttgatttgtggtggcaaggtgcagacagacatgtattaaaattacccgaggtatttctgacgggcagtcctgttacacagcactggtttaagcacacacagattctggatgggtcttcagaaccatttgctcttgtcacattccaccaggaaataaatacataaatcataagcatgccagcttctctgcatttgctgctgctacgataaaacatattccttattcttatgttccagtcaacgttccagacagtacagctaacggcagctgcagaaatcaacacctataaccctgagatatatgtgattgaagataacactgttacggtgagcatatcacacccttccctgtgagcctcagggtctgtgatggcattccacttctaaaagcctgggatagtcactcttcttacctacatgtatgtagaagtatcttactaaaactttaaagatctgatgtttattatgttgagattttggcgagggtgtgtgctacttaaaaagttcagtgatacacttgccttcctccatgccccccactcatgtcagcaaagctggctttcctagaggtggtgatccagtgagaagtacaacaaaaggggctctatgttctttgggactccatggtgtctcttctcatgactaagccagcagcaccagttcttcctttctcctcctgcttacacaaaatggtctggagcttaggccacaaaacttaatcatgcttatttaaatcataaattgtattttgaaaaatttttaaagaaaggtactgaagcatgcttaataaataatgcatttattagagggttttaaaaaatagttctccttacaactagacactgacactgtgtggcatgtccattcattagatcttacattcgggaggactataaatggtccccttgataaaaaaaaaaaaaaaagcttttacagagaaatgtactttcacagaaaacaaaggctctctgttctaagagctggcatgagataattttcctctgcactgactctggttagaatatgccatgtttagatacagtgggatttccatgcccagctaatctgctggcagagccctgagcattttcctcccagtgcttgtgttaggagttgaaagccagtttaagagtctgcccccaaggccagcttggcagttggcctcagtccactcctctggcttggtcaaaaagttatggccccatgaactatgggcctcctcactccatgcctgagagtgaagctcacagcactggagccccactcttgtccaagggaaaatgattctacgcaacagagcacacttctctgcctctggtttaggagcctcagtgaaagcctacaccctctcttcagacactggggcctggaaaatcagaaatagagccaaaggaaatgcagacttcaaattcaaaatgctatgaacttagcataggggagaagtattatagattttttttaaaagctcattttagaaaaacatagtgttcagacaatatgtgaaactctactgaagactgtttttagaaagcagtattaaatatatcaattggaaattcaaatgaacaattttaataaatccattagattcctcttttattggtttcctctgagcaatactaataaataacagaagccaattactaggtgcaaaagtaattgtggtatttgccattaaaagtaaagaaaggctgggcacagtggctcaaacctataatcccagcactttgggaggccgaggcaggcgaatcacctgaggttgggagttcgagaccagcttggccaacatagtgaaaacctgtctctactaaaaatacaaaaattagctgggtgtggtggtgcacgcctggaatcccagctactcaggaggctgaggcaggagaatcgcttgaacctgcgaggcagaggttgcaatgagctgagattgtgccactgcactccagcctgtataacagagagagactctgtctcaaaaaaaaaaaaaaaaaaagtaaagagaaagtacttttaatggcaaagactgcaattacttttgcaccagcttaatattactcagttgtgtctatgaaaaattttttaatctaaacaataatttggataaatttttgaataaggtatctaacctaaataataacttcacatgttcctaagtatctgttaatttatttgaatgcctggcccacttaaaaatctgatccacaaaatgctatagtcatgggtccatagggatccgtggttccctgggttagaaagctgtggaaaagagagaagtaggcttatgactgccattaagcagtgagctacaagaatttatcatcactttattcataaattgataaagccttacattttagctcttgaagatacaaatgaaaggaaatacagtcaccaaggccagttgcaagtttagcccagcccataaatttatgacaaaaagcagctcatctgccattgcaatttaatgttacatcaagtaaataaaacacatattatcctcttcttttgcttctaaatacagctctttaggaatattttctaaagagaatgcttgagacactttccccaattaattaaatttcccctaattaattaaaaactgaatatacagttttactgttaacactcagggcagccattccattacagcatctcaaagattgccaggaagcagatacaaagaatcctaagtagcctgaaggacaacgttcccactgaaaaggtcaacttgacccttgagatattatttctacttttccaacaatatcaacttggaatgaggtttaagtgaaactagtattttagacacccaatacaaagctgctgtttcatcaccatgaagttgggttaaagagtttcttcgactcccttccccaaagctgtttgctttcacttgatgatgctttcacttgatttgaatgtatgccagaaatggaagtttctatttcataagtaagataagcatctgagattgtcaggcatgatgtagccacaagacactgatgtagttaaagcggagaaactagaaaagttgtattttttagctggttggactttgcaggaagattttctctaaaattattctgacaatgtttgagatacgccatcatgagcaagtcttgtcacctttctagagctgtagaccttcacttacagaattagagaattggactagaccatctccccccttttttgtggtattaaaataactcaactgtgaactgacatttccagattcccctgatgataatgaaacctgatgagaaagccgaagtaccaacaggagttataataggaagtataattgctggaatccttttgctgttagctctggttgcaattttatggaaggtaagaaaagctttatattttaaaatacagggctcctgaaggccagccttgaatttgcttacaaaacatcaacttcaggttttatatggtaccttctctatcacaaggagaaaagaaatgcaaatttgtttataatttcttactcatgtcattaaaaacaaccagtaaggatttttcttcttttaaaccttcctttcatccagagccctgaatgttttgttcagcttcaaataagtagacgctgaaaaatgtagctttatgcaatgcagctgagctctctggatataaatttccttctagcaggtggtagatatcaggtcatcagtctgcacacctcccttcagagcctcagggattcccagaggtgcatcagaggacgtgggcagccaagggggtcagaggcaccttacaaaataagccacgggtggtaacattcttatatcatcacctttacagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatttatgtaaaatcccatctgctagaagcccatcctgtgccagaggaaggaaaaggaggaaatttcctttctcttttaggaggcacaacagttctcttctaggatttgtttggctgactggcagtaacctagtgaatttttgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatc

SEQ ID NO: 27 - DNA, 4637 bp, Homo sapiens
aggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgcaattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggccagtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcgccgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccagcgccaaaacaagccaaagagcctcccaccagagccgggaggaaaaggcccctgcaatgtggtgacacctcccctttcacacctggatccatcttgagagccacagtcactggattgactttgctgtcaaaactactgacagggagcagcccccgggccgctggctggtgggcccccaattgacacccatgccagagaggtggggatcctgcctaaggttgtctacgggggcacttggaggacctggcgtgctcagacccaacagcaaaggaactagaaagaaggacccagaaggcttgctttcctgcatctctgtgaagcctctctccttggccacagactgaactcgcagggagtgcagcaggaaggaacaaagacaggcaaacggcaacgtagcctgggctcactgtgctggggcatggcgggatcctccacagagaggaggggaccaattctggacagacagatgttgggaggatacagaggagatgccacttctcactcaccactaccagccagcctccagaaggccccagagagaccctgcaagaccacggagggagccgacacttgaatgtagtaataggcagggggccctgccaccccatccagccagaccccagctgaaccatgcgtcaggggcctagaggtggagttcttagctatccttggctttctgtgccagcctggctctgcccctcccccatgggctgtgtcctaaggcccatttgagaagctgaggctagttccaaaaacctctcctgacccctgcctgttggcagcccactccccagccccagccccttccatggtactgtagcaggggaattccctccccctccttgtgccttctttgtatataggcttctcaccgcgaccaataaacagctcccagtttgt

SEQ ID NO: 28 - DNA, 3567 bp, Homo sapiens
cgccatcccgcgctctgcggactgggaggcccgggccaggacgcgagtctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctcggcggcagaaaccgggagtggggccgggcgagtgcgcggcatcccaggccggcccgaacgtccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgcttagtgttgaatgttccccaccgagagcgcatggcttgggaagcgaggcgcgaacccgggccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccagttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagcccgccc

SEQ ID NO: 29 - DNA, 4243 bp, Homo sapiens
gtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccaaaaaaaaaaaaaaaaaa

SEQ ID NO: 30 - DNA, 5629 bp, Homo sapiens
gcgcgaccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgcggagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccatatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacagaaatgaaagctactcatagcgggggcctaaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagaattagagcatgggagggtcatcactatgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttacatactgtaacattcaggaattcttggagaagatgggtttattcactgaactctagtgcggtttactcactgctgcaaatactgtatattcaggacttgaaagaaatggtgaatgcctatggaactagtggatccaaactgatccagtataagactactgaatctgctaccaaaacagttaatcagtgagtcgagtgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttggggggggctttttttctttttccggaaaatccttaaaccttaagatactaaggacgttgttttggttgtacttggaattcttagtcacaaaatatattttgtttacaaaaatttctgtaaaacaggttataacagtgtttaaagtctcagtttcttgcttggggaacttgtgtccctaatgtgttagattgctagattgctaaggagctgatacttgacagttttttagacctgtgttactaaaaaaaagatgaatgtcggaaaagggtgttgggagggtggtcaacaaagaaacaaagatgttatggtgtttagacttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaaaaaaaaaaaaaaaaaactttatgggcacaactgg

SEQ ID NO: 31 - DNA, 4079 bp, Homo sapiens
ggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggttatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccacgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaaaaaaaaaaaaaaaa

SEQ ID NO: 32 - DNA, 206310 bp, Homo sapiens
atcctcttcctgaagatccagtcaaccctatttcccaccacttcctaacccaccccttttattccaatcccatgcacaaccatttaatctctgtcttttctaagtattaataccttccctcaacttctccccccacagtgcccaaatgtaagccccgtattcaaaatcctacgtaaatgtacatctgccaccaaatcctcttacatgcttcagaaaaaacttagctcttctgtctctaaacttcatatctgtttaacctcggctccttccggtttcatgctgacctgttttgtttaatgttaacgaatgaccatatgttatgtaaagggatctatactcctttctcttctctgtcctcccctactcaagcctcacgtcctctccgacacaggagacatgggaagagattgacaacacccacggatcagaaccgaaatctgaactcctgtagactgtgaactacaccttctacccccgcagaaagtaaactgtaaattccaacattcttaactgcgccaaacttcatcacaattacacaggatggagatttactactaagtcatttaatatgcccaagatgcctttaagaaagatttaaataaaatctcaagggctgggcaaggcggcttaccctgaaatcccagcactgtgggaggcttaggtgggaggatcgcttgagtccaggagttcaagaccatgttgaacaacatggtgagacccccatctccttaaaaaaaaaaaaaaaaaaaaaaagaagaagaagaagaaggagaaagaaagagaaacaaagaaagaaaagaaattttaaaagtcaactcgaggtggcaggacggcttgaggccaggagatcgagaccagcctaggccacatgagcagactcagtgtcaacaaaaaaaaattagaaaattaaccaggtgtgatgtgtcatctgcagtaccagctaatcaggaggctgaggcaggaggatcgctcgagcccaggagtttgagatttcattgatctatgatagcaccattgcactccagcttgggcgagagagagaccctatctctaaaaagaaaaaaaaaataaataaaacaaagcaaaccaaccaaacaaacaaaaacaaaaaattcacacatgcacacacacaggcgcgcgcgcacacacacacacacacacacagagacacccaacaacaaaaacaaaaaaaaaccctcgaggctttcttgtatatgagttagctctgccaggaggtggggtggacttaggggaggagagggttgttgcatttcaactttaactctcatcacagacgtgcaaagccgtgaacgctgaggtcaggctgcagaggtgatgaagagataattgctttgcccctcctggtggtggggttggttttcacattctccatccaagctgcgcctttgacacaactggagcaagctctcgctccacctggggcattgcttctaaagcaataaatagcttgaggtgacagagacgaaactgattgtccttgagatgggactgcaatagaaatccgggcagcccgaagaggcacccagcgctccagccaccagctgggccgcccgggagtccctggctctagaccagccgcgaggaggcgccgcgagagagctggtccctgcccgcggccggaggagggctagagcccctgggccagccccccgagccggctgggcgggcgggcgggtgggagcagacgccgggcactgtcaccacgggtgcgccgagcgcaccgacccgggacacgggcagctggggaccgccagattccaccagcccccccttgccccgcaggggtcctcggctcgcgctcctgggtagcagccacccaccggggcggagggagatgtcgcccggggccagccgcggtccccggggaagccaggcgccgctgatcgcgcccctctgctgcgccgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacgtaagtcgcccgacccggggaggtgcgcgcgggggcgaaggcgctcccgggtcaggtcccagcggctctgccgcggagtccccccgcagcctgggatccccgtcctgccgcctgcccggggtcccgtccctctccccgccaccagccccttctctcccctgccatgctagatgtgccttgtgaattttgagctagagacatgccacttgcatagaacacgcaagtcctgggtgttccaggtaccaagacgcacgcatcctacaaaggagagaacaggacccagaagacccaagccagttaaaaccgccaccacagcgaggtctgtttatgcagagtctgtaaccattgcgtctgggcgcaagagctgtcggctaccagcagctgggctctgtccttggcttcctcctaccccacccccttctctcatctcactgtacccacagagctccacctagagaagcaggaccgtttgcattcttgcaaaccaggttgcggacccccataggtttccaagaggaaatcaagtttgacagtcggtcctcatcataaatacgttcatgccctccacgcctgccccagtgtccccgggcaggaggttacagagactgcattgcatgcgcacggttttgtggcgcccaaagagtgactttctccaactcttttgcagagcgagtgtcttggtgggggcgcccaaagccaacaccagccagcccgatatcgtggaagggggagccgtctattactgtccttggcccgcggaggggtctgcgcagtgcaggcagataccgtttgacaccaccagtaagtgagatttgtccttctaagctgtgggcctgggtttggaagaaccagggccatcccagaggcgacttcccgctgtcttggtgtgctgctcgtttagcttgtctgatatgtccgtattgtgggctatgtgggtctctagagaaatcagttttttcaactctcagttaactgaaggaagacgtttagtgaaccctagagaaaggacactattttgaccctgagtgttcggatgcatcctggcaactcctgtttctttacctttctgagatgagcattttcagggtgagtggatgttttggagaaatacaaaaactatgtcctaactttgactgtggagagaatttggttgcttctcaaggacagatctggaaaaagagagatccttagcgtttccagtgcccaagctcgggaggcaggacttagctgctgcagacccagacatcactccgcgttgctgtttaattctttacagaaagaaagaattttctttcaaagtattagacattgaatgcaaactagtgcaggcagagtgtggatggattacattcatttccaaaatccctagacagatgtttcttatttaattaaagggaaaatacattttaaacaattcagtctggttacgtttcctctggtgttttctctttagagcctgagaaaataatttaaatgcgatgctttcaaaaacattaacaccgaatgctttaatttttaccaccaaaactttatgaattcaaaaggtatatattatcagaaagcaaatatctctttccagaaaaatgcgaatatgtcagcttgaacaatggtccttgataaataatcgtttaaaataccttgtgtaccacacaactattttatgacatacttgatttctttgatttttaattgtttgattagtgcgtatatggaatttatgcggaatattttcacagaatttcgatgaaattggctggatgatgtttacttgttactataatttgtatcttttatgttaaaggagaaaacaatttcagtttcataaatatgaaaatatttcaaagcaaaacagactatacaagcattaccttgaattatgaccaaattaggaaagtattttataaaagcattggaaaattatatttttatcatgcctgtctatatatggtcacaatagcttatcattttattaaatattctgttattttataccagtttttataagcttttacttttaaatttgagtattagcaaccaggaagattaaaccttttgatgttaatttgtgacagaaatcttttaattagttattttatcaagacttgagacactttctagctactgctctctagtttaagaataagcttcgtaaaccaaaagaattaaacatttaaacacaaaattaatgccattttaataattcatatccgaatcatttgtatttttaaaagtattttaaagcaggccaaataaagacatgaatcattaacattatttgaatttacattaaggaaagtatattttgagacatggttgatgtgttttcaccaagaagcaatttatggtcgtggaaaagaatttaataatcttcttgtatagtctcataacatcaaatcaggatctgattagtatttttttcttttgataaaggaagaatcaatgtctgccctgataagttacaactgacttactttgtaagtactcatcccaatagatgtcataggccaacagattaaaaaccagagaatccagatgtcaactatgaattcaaaaaataactgaccactcctaactgaaaattttcaatattaaattacaataggtaggccaggcgtggtggcttatgcctgtaattccagcactttgggaggccgaggcaggtggatcacttgaggtcaggagttcaagaccagcctgaccaacatggtgaaaccccatctctactaaaaatacaaaatcagccgggcctaagggtgtaatcccagctacttgggaggctgagacaggagaattgcttgaacccaggagggagaggttgcagttagccaagattgcaccattgcactccagcctgggcaacaagagtgaaactccatctcaaaaaaaaaaaaaaaaatacaataggttatattttccaagttcattctaaagcaattgcttgaagccttgaattcactctcccatacagaactaatgctgaaagatgtgctttggtttccagaatagcccacaggaatgcatttaacccttattgtagctgaattatatttgcagtaaaacagtaggggacaaactagaacaagttggcaattaaacagaaaaataatgtccagaaaatgtcagtgttacttggagaagacaatgtcctcttttgtgtaggttaggaaaatgtctagatatctcaaagggctttagagattgatgctgctcattccacactatgtcttattttacttccaaatatatagtggtttacttgataaatagatgaatgcactaatcctactattatacttatcaactacaatcataataatttcagaattcacaaatggaacaaagtgagagaaagaaaggggaagaaaaatcaatgttcctgaaataattgaacaggaaatttaaaaagcaaggcaggaaaggctacacaagtttgtgagaaatgaatggtccatgacagaatgaacaaggctgtgacctgtgaaagacagggaggtcccactggggaggagaaaggaattgttgggaaaagaaagttccccatgtcggccatcagggggtactatgggcccagaaaccttgattgccagtgggaatggcctgaaaatgggtgtggggaaggaatccacagggtcacagctcaggtgtttgctaccaagtggttgctcaccctctatacctcatctgtgccaattgctttgtccttataccctcagatagtggaactggcagtggcagctacttgatgcaatgctgtgcaagtgaagaaggcacagcagatgccagtgtagctatttccattctgaacatccacttcgtggacaaagtagaatgttaaaacgaaagatgaaaggtggaaacagacatcactggctctgggtcctgaagtcagtgttgccagaggcatcccatttacagatcgctactatgtaccagacacggtacacacattgtttctactacataaaacaaatcaaaacaactatgtaaaactcattctgtaaataaggaaactgacatcaaaggtatacccaagaccgtacagtggtaggtggtagaggcaggactggaatagaggtctgcccagttcgcagcctgcttgttcccctcaccttccttccagaaatggggagaggattgaccctgatagactgcaagttcaggattatgactaagcccccaaggagctttggaaggctatatttgccttccctccctctcctccattcccctactccagcagtggctttacaattccattttaaattattctccagagaggggttggaaaggataaacagttttggtggaagcattgtagaagcagggtttgtcttggtgggaatgatgggtcgcatatgcccctggtttgctcagactcccacagaatgccccttcatggtctctgataagctgcctcctgagttactctctgctcagtgccagtaacgtactgttctcccccgaaaaaaaggaagaaaagttctctgcttaactaagtagtggccccaaattgacatccgcataatggagtgtgatgtgtcaggcataaaaatgtatattgcaaatattcatctgtcaagacatcagtgactttcctggtcttttaccctacttttactacgacatctgaattcaagacatcctaagtaaatttgacctttcaatgaagttgtttcaacttgttcaggtccctggggtgtctacaattgggtattctgctctggtaaccaactaaattctctcagcttagactttgaaggagacagccctataactgagtcccagagtccagttgagatcctgttcctccatttatttaaggtcaattgccattttctaaaaactgcctttcaggttttttttcatgaaataatcattatttattttatttttaccttatcatataacttgattttctttaacatttctcatgatgaatacaaaaatagaggaagcttgcactaggcccagcacttcaaatgcatgaatactagaagcatatgctggtgggggagatgcaaagagtagataattttcctgctctgtacagaatcaaggggttccaaaaaagcacttctctgatctcccttctgtctttccctctttacttcaatagaagaaaattcctcctatcaccaaattggtttctttcacttttgtctcaggaactctttaaactatgccctatgtcttaaagagtttaaaatatcacatctgcctaattcatgcctctcgcttctgtgtctacttcaaggttccctttcttctttttcctacattttctaaaccaatgcatgggttaaagaatgttaggctgtaacccttctgctaaaagggagaacgaatgagacaatgaaatggactgtcatctttggaataatgaagagcaaattgcaacatagttccaaagtatagcatacaagtatttgattgttttaaatgctcaagtaaaatgtttgaggaaaaaggtgatgtgtgctaattaattatgataatcatcaaagcactaataatgacagagaagcaatacagctgggaaccagtcacagttaggagcccacataagaagttgacaggaagaggtaggaggtgccattgagatttggaagtcatctgagaaagaccactagaatttgcctggcctcaacttagtatctctgtgttaaaaaataaaaataaaaataaaaataaaaggaaaaagaaaaagaaaagaaaagaaaacttaaaatggaagacaattggattaggatatttcaaagttctggatgacaaggtttttgttggaattgcgggagaccggaagcctttgttttggggggtctgttttattttgtgttgagtgatcccacaatgagaagcagcttaaagcatctggttctgcaactggcttagggttgtttttttatagtgttcggtgtgccctttttctcatgtgagggttgggaaacatattggctgcataagtcttgcctttctagtttccccggaaagaaatcagtttttgttcaggaacaaagaaaagaaaaatgtaggttagagctacccaagtaaatgacagaggaaataacataaatgtgataggacttagggacaggagaaatctgtgctctaatacgttcacttggaagattacaaaggtgggggaagacggaagcccaaagataacctcctcttttcaagacttaacaatgagagtaagttttgctactcagaaaaaaagaagcagtgtgtgcacacaagcacacaccacaatatttgcagaaatcttcctctgctaagtcctgatccaactgagtcatcaaaggtggtttagctggatgtcttacttattattctagaagcaattcatgatggctactatgactggatatgttggcatgacagaggcaaccatcatccctaaatttctctctgtttgttcagacttcatgcaacagaacacaactgaaccttggtatgagaagggaggaggcagcggtccctacagcccatagcaactgaggaagcaattagaaaaaggaagtccttgaaactccaactagaaatgggaaacagatctgctgtatggctagttgagcagtatgagcattaggcacctattgcttaatctgcaaaattctttcaagaagctggaagtctgtgtgagggaacaggcttcaaggttcttggcaggaatattccgtgtaggctctgcagcatgctgggagaaatggcttgaaattatcttgaaatagtcttgaaattattctgaaaggaaaaacacacttttacatttaagctgacaggttgagatgtgcacattcgaactttccttcttagtgtataacgagtcttgtatctgggaattgcattgatggagagagttgccaactttacgaaaaagctcagctcaggggtgccctgatggataccatgacagtacatgaacatggacttttttattttttattttatttttatttttttgaaatggagtctggttctgtcacccaggctggaatgcagtggcacaatctcagctaactgcaacctccatctcccgggttaaaatgattctcctgcctcagcctcccaagtagctgggattacaggtgcccactgccatgcccagctagttgtgtgattttttgttttgttttgtattttcagtagagacagggtttcaccatattggtcaggctggttttgaactcctgacttcaagtgatctgcctgccttggcctctcaaagtgctgggattacaggcatgagccgccacacccagccattgaacatggatttttgagcaagatagctgaaagactaattattggttttattaaaaaaacactcattcatcctttaatcagcaagcatgttgaaagcattttaaaataatttttatttttcaaaattcagcttaaatacatgtttacaaagaacatatttattgcataaagcaaggtgttcctccataatgaaatcctaacatagattaaagtaatttcaattccaggttacatgataaggagatttaagatatgcaagctaattgtgactaagtgatttatacttaaaaccaaatacatctgatacaccagctatggactgctatagaattcaggtgagcaactcttagatgaatgtcactagatggtctggaaggagtggagctccacctcaaccctgctgaaaggccagagtttaggtctgtggtgtttagtgtattggcctgaaggtctgcaaattgagaaactttcctagacccataaacactgaagaaagtgattatttaccctttctttctttttttggggggtaaaattaaggtatagattacaaaaataagtctttatagaagtgatttccaggcattgggagtggaagagatgagttgactccaaaggtgtaatagcagggaatcttttgggggggaggttgatggaactttctatatcttgattgtggtgggggatacatgactgcctgtatttatgaaaacccatgatgctgtagatcaccaaaagtggattttataaatacgtaaataaataatctatattaatatgtaaataaaataaatgtataaataatatgaacaaaaagatgaagagaaaaaacctttatggagaaggcaagagagttacatatttgatatgatgattaaatatggttttgtggctgttgctctgagcccatggtcaataagctcttaggctatgggagggtctgatataacaacacctgggggtgtaaagacaaagatccctgagaagcataggccaccgctcctaagtaaggctgaacgattggtcagatcatcatgtaggaacttcttcaacattctttaaataaaggatcatatgttccgaatgtgtttgataagaagagtgtgaatgcaaacacgttgcataagaatatctatgcaatgaaatgttgttccttgtgtcattcctatatccttatgaaattcaggcacaaaatttcctcactggtagtcactgaagagagctcactttaaatacatgattgtagttatcaaaattagtataatggcactgcagggtatttacttagaaacatttggtcagttttcttcttcagctctgatatttgacataaggacataaatttgaatatgatattgcaaaaaaccctgtatcagtctgccctgacttccaggacatactgacacgagagagaagggcacacaccactgcaacaggaataggtttattcaaagacctgacccggcccacgctatacgcagcatctcaccccaggtacagcagtggaagccaatctcctgtggccaggttgtagttctattccagttgtctcagttgtcagagcctatgatttccccagatgtctcctatacctgccccctcttgcctcgctagttacacaactgatctctttgtcacagtgccacacagcacagtacagcttgtctctctagagcacagcaaacaactcttgcatacacacgtgttgccacacaccctgcaccatgtcctcctgcattcttagccacccaggacatcttgtcttccagaatgattttctgatacttcaggcttctctcctcctatagttcccaccaggatacatgtttcagaaattaattctaaagtagctacaaatccttttttaagaagaaagaaaaggggcacaacactaaataagtaatgtttttgaacagcctatttgtgggtagtcaatcaaattagggcataaaagcacacaattaaatattatataaccattaaaaatgaagtctacaaagaatcaagattaacatgagaagatttgtgtttcagtggtaaataaaaaacataaaagtcaaaattgtgtctacaacttcttgaaaaatataagaaggaaattgtaatgagagactatctttgggaaatgtgattaaaactgtttttttctcatgcattttttttcttgttttcaaaccatgaacaagtatttatttatgatcaggaaaaataatgaaaaaattaaacacacaaaaaaattctaaatgaaatgattgagttcactaaagtgctgtaaagattaacaataaaagatcagaattaaagctctggattagaagatggcatcttagttgttccctctcttgtcttgggagctgatggttgactggtttagaaatgcatttatttatataaagtacctaggttctaaaatactaaagatcaagggtattttcagtaacagtatgtgtaaaaataagaagatacagtgtaagtctcacctgttttcattctagattaactttaaagatagaaatacagacctgttctgacatggcagtttcaagagctgtttgtgtgcggaatagcttttgagtgtgtctgagtaagatgagcttaccagaagttaattcacagtctatttatactgcaatcagttcacaaaacttgttataagagcccgtaggaaagaaatcaagagtgaccataggtccagataatcccatagaccttaaaatatggaaggcattggatagagtcaagacatccagataaactcatgaagtagtgtcaaacatcatagcatgaattggtgtttagttcttgctctgttatgtataataatatttttttcctttaaaacattatatatgatgagttataaaatctacctagagcatttcttctggggtgcgccattctacttagtcccaagtaaggtttataaatgttctgtaaaggtgtgtctgtttactaagtaaagagtgtgtcaacacacttgccaacaatcttggttgagcagagaaaagtgagaagtttcggggaggagaactgacagaatgaaagctggagcagcgtttctgaaaatctcttgcacgttattcttttgtacgaaaatgaacagaaaaggttttatgtcaactgagttggtaaatggctgcatctgctccctttctatgacacttacaatgcatattctcttagaaaaggcactaagaattcacaaacgaaatcaacctattggattcataggatggggcctttgttaacattcattatttctcctcacatttatgaggtcaaagcagacccaaatggctgtagaaacaacctcgtatctttggcttaaagcatctaaggtttatttcttgctcacactgtaagttcagtgtgatttgatagggaggcttggccagttcaagccacacagggacccagcttcatggagactccttattggcacgggtgtctgagatcaccctaattggaaaaggggtgtgtctaattgcacactgtctgctacagcttccacctgaaattgacatttattatttaacatattttgtaggccaaaccatgcctaggaggtttgctgtgccaatttgtttaactatggaaaactttacttaactgcacctatcgaaattgtatctaccatctttaaaagagcatgagaaaggaaatgcacacaaacagattgtctttgggaaatgtgattaaaactttttttttaattttgcaggacaggtttttaggacactcagttcaaatatacagttattgggggctacagtgtcaaccccttcacttatgaatagacacatggcaaggagaggatgtttttgtgaacagattcaaagatatgagtgagacgtttataccaacactcagtcccccaacctgttccacctggtctccactggaaattttttttctcttttcttttcatttctctattcctgtgatagattatccattctttaccacaaagattacctgggaagactggatgaccttcttcctttcactctggttcctcaggtgacatattattaaatcattacacactttaacacacttttacttataaaaatgtcatctaaggggggaaaagagagttgaaaataaagcttagcattagcaaatggtaaaattaaatttcaggggctactatttgcaaccctgcacaggcagatgctgttcttgacgtggagtacgtccactaacaaagcctaagattttgtcccgtcggatggggttcataggaacagccagcgacaagtggaagaaaagaaagcgaaggtcaagaggacagagaatggtgtgtgtgtgtgtgtgtgtgtgtgtgtgtgtgtgtcggtgtgtgcacatttattttagcttgggcaggccatttgctttccattgctactatgacaaattaccacatgcttagtggctttaaacaacacaaactgattatcttttttttctttttctttccttttttttttttttagaaggaaactcactctgtcaccgaggccggagtgtagtggcacaatctaggctcaccgcaacctccacctcccaggttcaagcaattctcctgcctcagcctcctgagtagctgggattacaggcacccaccaccacacatggctaatttttgtatttttagtagaaacgggatttcaccatgttggccaggctgctctcgaactgctgacctcaggtgatccacccatctcggcctcccaatgtgctgggattaaaggtgtgagccactgcacctagccttgattatcttatagttctggcatccaaagtctaaaatgggtctccctgggctagcatcaaggtgttggcagagctgcattccttctggaagctcttgggagaacctatttatttccttgccttttccagctcctacaggtgacccacattccttggctctgggatcctttcctttgtcaaaagcagcaacatcttcttccactgccctatctctgggtctccttttttggcctcttcttccacctgatagtatccttatcattacattaggtccaaatgtatgatccaagataatgtaccattttgagatcagctgattagcaaccttaattccatttgcaatctcagtccagtccctctttgccacgtagcctaatatagtcagttttgggagattcagatgtagccctcttgagcggtattattttttgtaccacaggtggtcacaagaactttcactgaggaggtgatatctgagcaaggacctaatttgagtgaggaaaggagccaggtggtatccaagggagacatgttctaggttgtaggagtgtcagtgttagagtctggagatgtgggtgtgcttgagaaatggagaaaggtcgctgagctagagaaaagcaaatcggggcaagagtgataggaaattaggccagaaggccaggtataagcaagatggtatagtatcttcatggccagggtcaggatttgggattttattctaagagtggtgggtagccaatggtgggttttgagtaaggaagtaacataatttgaattatgttttttaaaagatcagttttggtcagtcatgggggctcacatctgtaatcccagcactttggaagaccaaggcaggaggaccacttgacaccaagactttgagaccagtctgggcaatgtagcaagatcctatctctacaaaaaagttaaaaaattagcaggtgcagtagtgtgcacctgtagtccagctactaggaaggctgatgtgggaagaccacttgagcccaggagttagaggatgcagtgagctataattgtgtcactgcactccagcctgacagagtgagtgacaggagggaaaaaaatggatcagcttagattttgttgaaaaacagactatagacaaggaagagcagaagcaagcaagcaagcaaggagactaggtagaagaccgttccctttccggtgaaagggaagtatggctgggattgagtggtagcagttagagctgagaaatgggtggtttggggctttatttggaaatgcaattagtaggttatcattatggatcagatgaagagtgcaaaaaaagaggaaattttggcctaaggaactgaaggaataagacttagagaacagtgggtaaggagcatgtcttagatgaaatacccagggttgagtccagatatgtgaaatttaagatgcttattagacctcccaacagatgtcgaatgggcacttggataaataaactgagagctcaggcaagatgtctgaatacaaagataatatttaaggccatgacttagggagtgagtgtggatgaagagaagaggagagaggcaaagtgaggccaagacacaagagcagaaaagaggtgagaatgagtttgagattgactcctggggcaccatgacatttacagaaataccggggatttgaggaggatgtgtacaaaacacaaggaaggagccaccagttaggtaaaagaaagccatgaagccaataaagaaagtcttgtgaggtgaagtgaaatgaggatggaaatttagaacatttgatttggcagctgaaggttattgatgactgaaaaatccagttacagtggagtgtgtcaagagagaatgggagatagccaatgggagagagtaagtgtgtgtagcaatttttaaagtttggctatatatgggaccagagaaatttaatagttaagaaggtattatagcttgattatagtctaataggaattatcaagttcagatgactgtaagagagagagaccatagtcaggaaccaatttctgagtggagggaaatgcaggggattcctctacaagtggaaggactggccttagagcagcagaaacgcatttcatctgcagtggcaggagggcaggcagagtcaggaaacaactgaggatgagctgctggattggatggcaggaggaagaaaatgatcttttctcattgcttgcattttctcattgaaacaacaagcaaagtcaccatctgaggttgaggaggtcaaagagaaggttgggagcaaaaggaaattcagagtagtggcagaatggcaaagtggagtcatgaaataataggattaccagacaggaagttggataagtaaccttttgcctttgttcagcctatagcatggccctacctgtttaggtaggatttaagaagatctcccatagaataatttcctctcgagtgttaatcttccctaaggataaattacagacacagaaggtttgaattctggggtacctattttgtgtaacattgggaatggtgactttaaaaaaacaaacaacaacaacaacaaaaaccataatacgaactgttctgttaggtgaatggttgggaccctttactatatcttttggcagcaggcatgagattcttagaaatataagaccatgtaacaggaggcagtgtaaatacattttcaagtgttattgggaggcaaatttatacagccttcatcgtgaaacccaatcctatcctgtatttaaaagcactcctttgaggtcatattgaagaaatttatgtcagtgagtcaccttcctgagatgcccatgctgagaggttttcattacttcttgaagcaaataaatgattgggtactaaacagaagcatgctgtgttcctggccatcagaagttgacattgaagccatattgagagttctcatttccccagctgtacctatgactacgatatgtgatcctaggtaattattccaagtgtgaaaaaaatctagaggtgaaagaaagtatgaaagattcaagtacgaagaaagctgaaagaaaaccatcgtggttgagagtgacaaagatgatactgacaggggaagggttttgtaaacctggtttcgcatttgagaaaagttgagatttgagaaacaactctggaaagaaacaactctggacaatgtagcaagaccctatccctactaaaaaaattagcaggtgcagtagtgtgcacctaagaaacaggtgcatttgagaaataactctggcttcaggatagagaatggatttgaaggtggcaatgctggaggaaggcagactggtcaggaagctgtcacagcaacagaggctaaagaaaatgttgaccataactagggaagtggcaacagggatggaaagaagtagatggatttgggagataacaaaaggaagcatcaacaagaattgatgactcattgaaatatgggagtgcaagattggtgatcgtcaaggatgcattccaaggttctggcttggttaatggggttaccattatattaggtaaaaatagtgagcaagacagacatcctctgatctcacaatattcaactttgatgagatagtagtgcctggcagttctaatctggtcttaagtgctgtaacagcagaaagtgaagaaggcttcaggtgttcaaaataaggactcatgtgcttgaatcaatggggggcttttgtgttttgggggaggattttcagagagtacaacataaaaggttggagctgaagaatggtgtgtctgtgtgtttgagcatgcctatgtgtgcgtgtgtgcatgtctgtctctgggatggacagatgagagaaaaaactgttccagcctctattggatgtagtgaagtcagttgcagaagatgaggtcaacgttgtctcagtcagtacaatccactgtaaccagctctgtgtgtcacactgttgcatcatacttgggggttttgtttttgtttttaatctgatctggcacagataacttatcatttcccttggaagagataattctttcatttctcaactcccaatttcccttgcattatatccaaaatattatttgcatcgtataatccataggtatttcctgaccaaatcatacatactacttagtcaatttatatgtgaaaaacattctgaatgatagtatgtgatgtggaaaagccattcatatttactaccaagcaactgtctgaagaacactggctaggcactattggttattcaagacaggaagttagaaatgtgatctctgttcttaaggaagacagtctagacatgaaaataattacagcagaaaatttatattctcatccggatcaggaaaactatacaataggcagactaatataatctgtactgttgctattacaagcccatgtttatgaaaatgattattaaaactctaaaagcatgcatttagctcacttagctttgttattatagtattcgattatatatgaaacttaatatttaaatagcgatatgaacaaataatttaaaagggaagtttcatgatttccaggaaagaatagtttatttcactatgaactagaggaatagtctacaagcttcttaaattctgaatgagtttaccaaactgaacagtgactaagtccagggagttgtattctaatggcctttcacttgctaccttatacagttctctatacaagttttgttactttgtactgtttgaaaattttgaaacaataatctcaaagaatttcaatttgaaaagatagttttgagccctaccttttaaaatgggcttttaaggagtgatttgaacaagttggcaaacaaggaaaaaaggaatttcaccaaagaaatgtctgaaagaaggccatggaatgagactcaacagggaacagaaagaaagttaacccaaatggaaaggaagcccaaccaatacctagagctcaggctgtggggtcaagatcttcacgtgggccacgcgcggtggctcacgcctataatcccagcactttgggaggccgaggtgggtgaatcacctgaggtcaggagttcgagactagcctgaccaacatggtgaaaccccatctctatcaaaaatacaaaaattagctgggcacagtgggggccacctgtaatcccaggtactcgggaggctgaggcaggagaatcgcttgaatccgggaggcggaggttgcagtgagccaagatagtgccattgtactctagcctgggcgataagaatgaaactccatctcaaaaaaaaaaaaaatcttcaggtgtggagggcagggtatttatatttgatctatcaggtaaagataagaaaattatttaatgtgcgtgtaagcatgcacatatttgtatatagtatgcatacgtgatatagatcataaaatactcatttaatcaaaataacacatctctcgaacatcgtaaggaaaactgtgatattctttaaaggtttttcagagtggttttggagtattgggagccatacatttggaagtttaattttctgtgatataaaaatcaatccaggtccttttcttggatttgtttcttgtagacaaggagttctctggccaaggctgttttattttgaattatacatacgagtattccctgttctcagatgcatcattccaattagaaacttttatagcataaatttgactatgataaagattataaacaaatggttaaggatttcttctacccttttcatgattaaaaaggtctggatagctcctgcaacagctttaagaaaatctccaaggagacaaacttaaagtgatgactgaaggttgtagggaaacctactgttttctctactgggtcaggggctttataaatagttttcaaaaattatcctgtctgccaaaatgtttggtcacacctgtgtgagttacaactcttctcttctgtcccagggcgatctctcctcacttcgtgtaattcctctcatttcactaggctaaaagattagaaaaatctgcttacagcccacgtgtccaccatattccacatcccctcactcctgctctgaaatgcatattcccatgaagaaaaaaaaaagaaccaaaagctgccaatttcagagagatagcttcaaaggccagaaatggaggatgagtcaaatcaattgtattgataccacccatctaaagttcccgggttgacttatacatcttttcagtttatctttaggttttccccttttcagatcacagatgtactaatactcatggtaaaggctcaaacgattcagaaatatactccatgaaaatataaaagccaatgacacctgtatattccttgctttcaagataaccatcactcataggttagtgtcaatacatacacacacaagcacaatcacaatcacacatacacatccatgcatagaatatttgacttttaaagaaaagtgggatcatactgaacaatgtacccttgacaaatttttgaatgaatagatgggaacttggttattcattcatcaaacactgatgatctactatgtttttggcactggaaaatgcagaggtgaagcagacaacatctctgtggaatctatgtatattctcaaagggtagataatacctatataaaaacatagatttttaactcctatatagtattgtatactattgcagtaaacatgccaatacgatcatctcagatagtggtaagcactatgaagacaatgtaaaggggtaatgggagagtgaatgacaatgagtagacagaactggtggcttagggcttgtgtctctgaggatgtggtactggaactattcatgtcctcagcccactttttgatgggattgtttgtttttttcttgctgatttgttcgagttctttgtagattctggatattagtcctttgttggatatatagattgtgaagattttctcccgctctgtgggttttctgttaattctgctgattatttcttctgctgtgcagaagcttttcagtttaattaagtcccagctatctatctttggtttggctgcatgtttactgcatgcgacatcttatttgcatgtttactgcgatagcatacaatactctcatctgagtaatgagaagaaggcagccaagtgaagcactgtgggaagagcattccaggaagaggaaatgcaatggcaagactgaaaatgctgggtgtgttcacaggacaggaagttggtgtgtctgcaggttgaggagcatggggaggcaggagatgctgagattggagaagcaatcaggggccagacaatgttggtcccttgggccaagtcaggttttattattgcagaggtggaactataaatcaccgggaagaaatggattgctcagtaagtgctgtgggggcaagtggcttttcatattgaaataagaaaagtatctctgccactgtataaacaagaataaattccagatggacaataatcccaattaacagagttgaaagactagaaaaatattggaagatgatacttgccacatttatgtgggaaagagaatcagtaggcaaaaatatatgaattatgaatcaatgaaactaataactaaacaagagaatgagcaaagaatataaactggcacttcacagaaagaaaaaagtgaatggtccacaaacaggaaaggatgatcagccttactaaaagtcaggaaaatgcaaatgaaaacaaaatgaggtaccattccatggtcatctagactggaaaatatttaaaagtcctcctgtaataacaaaagttgagaatccctcactcctccactgctagtgggcataaaattgtagctactttggagatcagttgccatgtctaatcaaaagaatatgatcattctctatgacccagcaatgtcattcctagtttgggtgctggagagaaacccttgtacataggcacatggaggtggatatatgaatgttcagagctcagagtagaagtgggaaaactggaaaaaaacccacaaatgttcatatgtaaacggaatggataaataaaatgtagactattactcaatcggatgcaatgctatacaggagttaaaaagaatgagctagactgatctatgtatgtatgtatctatctatcatctgtttttctatacattcactcatctatgtttctatatatctatgtatctagctagctagtcatctatctattcatgaatatttctcacaaacataaaactgagggtaaaacacaagtacaaactgctaagtacagaaaatataatgccatgtttttgtttttttgtttgtttgtttttgagatgcagtctcactctgtctcccaggctagagtacagtggtgtaatcttagctcactgcaacctctgcttcccaggttcaagcaattctcctgcctcagcctcctgagtagctgagactacaggcatgtgccaccacacccaactactttttgtatttttagtagaggtgaggtttcaccatgttggccatgctcgtttcgaactcctgacctcaggtgatctgcctcctggactcccaatatgctgggattacaggcatgagccactgtgcctagccaaatgccatgttttcttaggcaaagactttataatcaagaacccaaaagcaaatgcaaccaaaacaaagatagatatctgggacttaattaaactgaaaagactctgcacagcaaaataaataattgccagagttaacagaaaacccacagagcgggagaacatcttcacaatctatacatctgacaaaggactaataatatccagaatctacaaagaactcaaacaaatcagcaagaagaaaacaatcccatcaaaaagtgggctaaggacatgaacagacaattctcaaaagaagatatacaaatggccaagaagcataggtaaaaatgttcaacatcgctaatgatcagggaaatgcaaatcaaaaccacgatgtgataccacctcactcctgcaagaatggctataattaaaaaattttaaaaaaatagatgttggtgtggatgttgtgaaaagggaacacttttacactgttggtgggaatgtaaactagtacaaccactatggaaaacagtgtagagattcctgaaagaaataaaagaagatctaccatttgatccagcaatcccagtactaggtatctacccagatgaaaagaagtcattatatgaaaaagatactagcatatgtgtgtttatagcagcacaacttgcaatttcaaaaatatggaaccagcccaaatgcccatcaatcaacgagtggatcaagaaagtatggtatatttatacaccacggaatactactcagccataaaaatgaatgaaataatggcattctcagcaacctggatggaattggagaccattattctgagtgaagtaagtcagaaatggaaaaccaaacattgtatgttctcactgataagtgggagctaagctatgaggatgcaaaggcataagaatgacacaatggactttggggacctgggagaaagggtgggaaaggggtgagggataaaagactacacattgggtacagtgtacgctgcttgggtgatgggtgcaccaaaatctcagaaatcgccactgaagaacttactcatgtaaccaaacaccacctgttcccctaaaacctattgaaataaaaaataaatttaagaagaaaatataataccatttttctttacttcacaagactgcaccaaagactactctatcaactgtcggcaaactacaactaaaactggcccaccatctgtgtgtgcacagcctatatgctgagagtagtttttatatttttaaatggctggatatatgtttttaaagaataatatttcatgacacataaaagttatataaaatttgatttccatgttcctatatgaaattctattggaacacagccaagcccaagcccattatttaacatactgtctatgggctgcttttgttacagggcagaattgagtagctgtgacaaagattatacagtttgcaaagcctaagacatttatctagtcctttacaggaaaagcactgtagaccacagccctgtattattcatgacattatttttcaaatggccagaaacacatacatttaattcctgatggtggcaacctctggacggggaggagggaagaggaatggaatgggggacaggtgtcaaaacgtgccgtaatgtttgtgaatcgcaatttaaaaacattgtccattcttcacaattattgattcttcctggtgagaatacctgtgtttcatgtattaaagtccttatatttctctgtacttttaaaaaacctcagaaaagctaaaaatacatgtattgtgtaaacatttttctgtatcagtgcatacaaatcatatgtgtataacagttgaatcttagtctatcttatagatagcagatgtttctttttgagtcccttatttataaacatttaagttgctccagtttttggtgtcacagtgtagcaatattttcatactatttcttgtgtgtgtgtgtgtgtgtgttttagagacaagagagtacttactctgagactttagagacagaatactcttactctgtcacttagactagagtacagtggcacgatcctggcttacttcagactctacctctcaggctcaactgatcctcccacctcaggcatgggctactatgcctggctaattttttttttttttttttttttggtaagagttagggttttgccatgttgtccaggctggagtgcggtggcactatcgtagcttactgtagccttgaactcctgcctcaagcgatcctcctgccttggtctcccaaagtgctgggattacaggcatgagccactgtgttattatttctactgaacaaaatactgaaacaattttttgatcagaaggaaatatacatataaaattaggatatgtggtgccaaatggctgttccaaacttcagcatgaaattattgtcttgaagtagagcaaatgttattaatttggagccagattggtaagtgacaagtggtaagttattactgctttaatttgaggctcaggttgtctctctgaattttcaggctaatttatttttacctgtaatgcctgttcggatccttagaaatttttttctattgaattttagtctttttctcattgatttggggactcttacatattacatatattcctcctattcttgaaaaattttcactttggttttcgtttattagttttgttaatcaccttctgccacttagaaaacttgacattgtatgcagtcactataaaagcttttctgagcttttgcctttgctttctccgtagtttgtgatatgctgagaggctcgcttaggtaactaacgggctccatcctctcccggaaccactggtccttttgcgttctgtggggttgacagtcctcccggggtaacccgatgccttccttctgcttcagacgacaggcggccctaccctaaatgcgttgtcccatgtcagtcagcaggtttggttaggaaaacagaaagcacattgagtattacaactaggaaggaatttcacgcagagtctggcaggctttcatggacgttggcaaggatagggtgtgaaagtctggaaagttgctacctgcagatcaaggaatttggaagttcagggatcacaggacttgatctctgctgtccaaaggactaaagaggtgattgtcaggaggatatgtgggagctgctggaagaacatcacatctgtcaccgctgatgtccacatgcttcctgaggctgtcaccagaaaaccatggcttctctttctttccctgttctcaaatctctcctgagcctctcattcattcagaatcctgctcattagaaagtctaggaaatgtattttccatactttcagtccttgccataaagagaagagactggaagggctaacacagtgctgagtattgacagacattacttggaagtagttttcactaaaggtcagatcaaattaaatcaaaaacatcctccatgcatcatagtttcattgagcactaggttgacatagtactgagcagtgtgtcagcttatttggcatgaaagaaccttgcttagaaaagagaaataagaaattagggaaagcgcaccttcagagtcaacccatatatatcttacttatttgaaattttattcaattacaatgttaggttcaaagtcagataatttattgaaataataaaacagaattttagaaaggtgatttgttgacttcaaaggtcaatgagaggaggacacaccagattaaaaactcgtctcagtacatagagacctgggacagtgcaattctgctctgttataatccctggattggatatgaaattaatgaagcccgttcatttgtacccttggtccagaagaaaaatattactgccaaattgcccagttgacacttgcaatcaagttattacacagttcatcctataatggcagaaaggatatcttgggaatcacacaggcagaattacataactttaactagcaaaggaaggtcccgttcagagctggcttattttttcccctagaattcatttccttcctcactgaagtctgctcttctgaagtccttctgcgatctcctttaactctgtttgaatttttgaggcactggtctccttttcgtggttagtaattttaagactactctagcactttctccctgtgtttaatctaagccacattgacaatgttgtgaggtgtcataagttcattcctgagtgccacaagtcactactaacaacatattatacttttgtgtctggggggttcttttgaattcttggacttaggttgaatttctaggttcctaagagagaaatacatatgtcgacatatatatatatatatatatatatgtcgacaaatatagatataatatatattaaaatatattatataaatatattaataaataaaatatatttactatattatatatccattttatatattttatatattttatatattataactctataatatattagatacatttttatatattataaatctataatatattagatacatttttatatattatagatatattttatatataatagatgtattataaatataaatgtaagatatatcatatatatgatatattatctgatatatgatatattatctgatatgtgatatattatcatatatgatatattatctgatatatgatatattatctgatatatgatatattatcatatatatgatatattatcatatatatgatatattatctgatgtatgatatattatctgatgtatatgttatcatatatatgatatattatcatatatatgatatgttatcatatatatgatatattatcatatatatgatatattatctgatatatgatatattatctgatatatgatatattatctatataatatagatatatgatatataatatataggtatattataaatataatatagatagatttttaaaaatatgtatatattaaagccattgaccttcatgtagttgtaacgctgcaagatctctgtagtacaacatcaacatcccagcttaaggggggataccttaagctggtgataccaagctgtgataccaaaacacagacttacgctgtcttcaactatcttaagctatctgtcattaagagatttaaaaagaaaaaaaacctatggaccttcagctgtattgctacaagatttctgtttatgacttcccaatttacaaagaactttcacgatcacttatctcatggaaccttcgtgactttatgaccacctgtgcaggagaaggggaatatattctcagcctcattttatagaagaaatcgaaactgcaaaagattaaatgaattgcccaaggtaacctagtcagagatggcaagaaatcttcagcttcaaattctatcatcttccaagcttcctagacataaatagaaatgtctatattttccagtttaagctacaaactgtaagatgctgtaattctttgttagtcatgtgcactttgggtgaggatttccagaacttgttttttaaaaacatctggaaacatcaaaagcataagatttttaagagggaaattcatgattttctactaacatgtcaaaatgtaaattttaggttaagattgagtatgtataatttattctttaaacagtctgtaatcataagtaaactcaattgaaagtttaattacatgtttattttggcctcacttaacaggaataaaaagtttattttgtaatgtatttttataaagtcaaggaagaaaaaataaaatgcaaaccacaggaaacacacaaataagatgcccttagtacaaatgtcttttgaaactcattagctattactgataaagctctagttaaaactgtgcaattagaaccatgtgtgaaatagttgaatgtgcaatcaagagtgaaagaaaacatgcatgttttgctttattttattttattttattttattttgagacagagtcttactttgttgcccaggctggagtgcagtggcacaatctcagctcactgcaacctccacttccaggttcaactaattctcatgtctcaaactcctgagtagatgagactacagatgtgcatcactgcgcccagctaatgtttgtatttttagtagagacacagtttcaccatattggtcaggctggtctcaaactcctggcctcaagtgatccacctgccttggtctcccaaagtgctgggattaccggcatgagccactgcacctggccaagatgcatgctttttattaagaactaaagtgtgttataattgggttgagtttctacccagatggccccactcatgctgacatctgcaaagtgtatgtacaattgtgttgaggtgttatctactgtggctgtgtagacatgtgttactgagttaaaaaccaagactttggagtccctcatgctgattcctgctaacacatgctgggaagcctctgttattcagagtaggcagaatcccatgtgtttcactattgggaaagatttggaaatatttagagcagttataaatatatggtcttcaatatgaaatcaataactgaagtgtagattcaaggataccagagtctacactaagtttgcaaaacagttacctctgaaatgcaaatcttaagaaaatgcttcttttaagttgtgaaatgtcatggttgaatacatattttcatgtcatatttatctaatgggagtcatgctcttagacttaaacaaagagaaatccccctctatatgaaaattggtgctcaagttttttttttaattgacaaaaactgtataaggctgggtacagtggctcatacctgtaatcccagcactttgggaggccaaggtgggaagatcgcttgagttcaggagttcaaggccagcctgggcaacatagcaaaaccttgcctctaccaagaaaaaaaagccctgcatggtggcatgcacccgtatttccagctacttgagaggctgagatgggaggatcacttgagcccagagaagtcgaggctgcagtgaactgtgatcgtgccactgcattctagcctgggtaacagagtgagaccctgtctcaaaaaaaattgtatatatttatcgtgtacaatgtaatgttttgatctatttatacattgggaaataattaaatcaagctaataaacatattcattacctagcatggttgccttttgtgtatatgtgtgtgtatattaagaatgtttaaaatctattctcttggtcacctctctgtacaataaatctccataatttactcatcccaactgaaactttgtaccttttgacaagcatctctccaatcccttctgccctccccagcctctggtaactaccattctactgtttgcttctatgagcctgacttttttagattccacatataagggagatcatgcaatatcggtggttttgtgtctggcttgtttcaggcacaaaattatttgtgccttagcatgatatcctcaggttcatccatgttgtagcaaatgagaggatttcctcttttaaggcaaaattgtgttccatcatatacacaccacattttctttattcatccgttgaaggacacctaagatgatcccatatcttggctcttatgaacagtgctgccatgaacatgggggtgcagatatattttcaatatgctgatttcctttcctttggatatatgcccagtagtgggattgctggatcatatggtagctctatgtttaattttttgaggaacttcctttaatgtttttcataacatctgtactaatttatattcccaccaggagtatgctaggggtccctttcttcatatcctccacaacacttgttatcttttgtctttttgataatagccctgctaacacgggtcaagtgatgtcttacagaggtttaatttgcatatccctgatgattagggatgttaagcattttttcacatatacctgttggccgtttgtatgccttctttcataaaatatctgtccaggccctttgactaatttttaatcaggtgatttgttttcttgctgttgagttccttatgtattttagatgttagccccttatgtacgtatagtttgcaaatattttctcccattcataggttgcctcttcactttgttggttgtttccttggctgtgcaaaagctttttaggggattggttgggtagcgtgcattggctctggttctaggtgggtgcagtagtatagtttctctgaagcttcttcagctgtgattaacatcagtgatgacagcaggatttgtggacacggtggtggcaaagtaagttgttaggctttttgatagcaagagtttcagaaatctttctgttttcatttttcctacagtgagaagacatagccaaggagatccctctttgtgttgggtccaacatggactgcaggcagccacggggtgctatgtttcaggcacaggtgctcagagtggctgtggaactggggtcctgtttttgaactactgtagcccctgtgacgagggcacaggttcactcttcaggtgtgggtagatgcagctctcccaccaagccaagggctgtgactgcagcactcacctgtagccgaggcccaggaggcagggatggagctatgacagtgatcctgggtgtgagggtgcagcgctggcatggctctgcagaggaagaggtatttcagaggctcaggccctggaaagtagggcacagctgcaattcaggttctggagccaacagggcatatgagaaaaaataccacaatgttgactttgaaccctggagtgctggacacagcagtggaccaggctctgtgaggccgggtgcgaatgttggcttcactccccagggaggtggggagcctcagcagctcatgcaatggaggtctgagctccagcacttaagggaggtgggtgctgctgccatttggcccaatagttgggtagtacagctcagagaaagctaagtttcccggagagggtgggcaaagcacgggctcgagtgcagagtcacagctgcccctctgcaccaaagcatcaattccctgggaccaaagctcccttaagtgctggagctcagccctccattgtatgagttggttctggcgccgaaggggtgcagctcctctgtgggtttggattcagcttttctgctgggcccacactctgagtagctggcagcagggcacagtggcaactgggatgggcagatgaagggcccagagcgtagggagctgcagcaggttggctggggattggtgcacgctgtgtgtctgtgtgaggatagtgaatgatggcagaacctcaaggatggagggatgcagtggctagtggcccccagagcgggatgcactctagcagtggctcctgtttccagatggctcagtgcagtagctgctctggtcacaggagtggggtacaaagtgagctccgtctctggagttgtgctgctgtgtgaaatgcaggtagctccccagctgggctcagggcttgtgaggactgcagaattctcccgaagcaaagactgcaggtgtccacgacagtgatggggctcaggaggcctcctgctcatcttttccttcctggttctgagttcatcctggcttaggagatgaaatggtggaggcgagagggtggatcacttctctctgcggccatccggagtttctattctcacagggtttttgccactcccttgctgttctccagcgatctccttaagttagtctggttgcaatgtagttgtctgttattgttttggtccttttttgtaagggagcaagtgttaggcccctctagtctgccatctggctgatgccatctgtcctaagtactttttaaatgttattgtaaatggggtttttgtatgttgattttgtgtcctgccattttactggatttgtttatcattttcaaatagtttcttggtgaaatctttagggcattctatatataagactatgtcatctgcaaacagggacgatttaccttcttttctgatttggatgtcttttatttctttttcttgcccaactgctctggttaggacttaaaagttctatgttgaatggaagtggggagagtgagcatttgttcctgatcttagaggaaaagatttcaacttttcactgctaagtgtaatgttagctgtgggcttgtgatgtatggctttcactgtgtgtaggtacattccctctataactaacttttaaagagtttttatgttgaaagtaaattgaattttgtcaaaggctttctctgcatctattaagatgatcatatggtttttgcccttcatctcattaatgtggggtagcacgtgtattgatttgctatgttgacctatccttgcattccagggataaatcccacttgaacatgatcaatgatacttttaacatgctgttggatttgagttgctagtattttgttgaagatttttgcacttatgtttatcaaggatattagcctgtaattttcttttcttgtaatgcccttgtctggctttggtatcaggataatgctggcccttggattatttccttctcttttatttttttgagacagagtcttactttgtcgcccaggctggagtgtagcagcacaatctcagttcactgcaacctccacctcctgggttcaagtgattttctcatctcagcctcccaagtagctgggactacaggcataagccaccacgcccagcatttttttttttttttttttttggtattttttggtagagacagggtttcaccatgttgcccaggctgatattgaacttctgttctcaagtgatcgtcccgcttcagcttcccaaagtgctggaattacaggcatgagccaccatacccagcctcttttcaatttttttggaggagtttgacaaggattggtattagttcaagtatttttaatgtacaaatttattatgtgttttaattggctgccacattttacaaattattaactcttcctatcttctttgacagacaacagaaagatcagagttaatggaaccaaagaacctatcgagttcaaatccaatcagtggtttggagcaacagtgaaagctcacaaaggaaaagttgtggtgagtatgagccatgggcttgtgctgctgctttggagtatggtgtgcactggaatgttttcaagctcatgtttaggaaagctctttcctaaaggaacatgttagactttcaacgataaggctgttggcattttaaaagcaactaaatgcttaaaattaaagaatgtattttagtgtttaaagctataggaaataaagcctgttttccagaagagcagttaaatattttcaaatatttcaaaaacaactaagaaaagtaaaagctacatcttaaagtggtaaaatattatagtgcttaagactgacttaggggctacttaaaatctgaccagaaaaatgggactattcccataaggatgctaagttaatctgctgtggtttcattgatcctttttacaccgaaaggaaagctgtctttcataataatttttaaacggctaactgcatgattctctgagttcattaatactttttaaagtaaaaacactcattctcaaatagataatctttcagcttcaaagtgctatgacttaataattctattattttattgttctgagcaatgatacatgtctaagttaccgagaagaaaatgactattgaagtaatctggaagtcttttttagtttggggatttttttcaacctattggctttaatttccttacaacaataaagcaataactttggcttttaggatttgttgaaatctacttgaattatgatttaataagaataagtatctaaaggaaatgccttactttatttagtctgttaaccccaaaaagattttgacataaaacaggtaaggtataaagagtatacagccctctccagttaagaaatccaacattcacaatatagtttttgtagagttgtctttgcattaatataattttcacattccagaatttgtaagaactttttaaggtggtatatgccttatgggaattgctgttgaaaaattaactctgtaataactgtttggggctttaaaaatcttttggatactgttttgatttttttgtgtgtcttgaaattttagctgtaacatataatagttgcatatttattcaataactgtagaaaccctcaaaacaatggaaactacaataatacaccgtgttcataataaaaaatgattaatttttggcatgcctgcattttctaaaatacgtgatgggaaataggataatacagagtatatttcaagctaaattttttgagtgctgaaacttagcagaatgaacatttaaattctttcctatatggtataattttataactgcaaaatcctacctccagaagtatcatttttgtatatccaggtaccatgggtatacatagcgggtttgggtcaaagcctaaatatgtcccatcagtatgtttcacatcaatgtgaaactgagcagattgaaagagtaactttttagagctaatatcaggcaaacactagaaagaattttcatggcatgaaatgccttttgatgaaacagaaggtgaggccagttggagaagatcaagctacacaagtgaatgcttcatgatgtagacttccctgtgctttcgcatctgcaccttatgctgaatttatgaaccagataacttggggaacctagaagagttagagagttttggggtattggccaagactttacaatatatagagaggcaaaaccaaacaactgaagttgtagaagggtaatttatttgagactaggagttatctttactaaaaatagttatacattgggccaaattaccaaggacagatttggaagcatagactactttcaaattggaatcttttttcacttctctggaattaagtgtgataccatactatcaaattagaaggcaggctagcagctctgtgttctacgattctgtctttagagatgagtatttggagaatcaggtacaatatttacagaaggttcaggcaagaaaaacagaagtccaaaccaagctaatgttttatatgcatttatttcctctctcattcctaacaaaatgttatttcatttacttgacgaggatttctcgttatttcatttacttgaagaagatttccatacagtgctcttgtgagaatctaaacttctaaaaaagcagccagatcatttcatgtttttcttgctgttgtttcaatttatttttgccgataatatttctgatattaggcaaactaattcagaagcagttccctctttttaccataatgtaattctaaaaaggggtcataggcaatgacataaagtatgtcttattttctctaaagcaacattctgaaaatgaaaaggcatggatgaggcatcaaatcagtttctgatatgacaaattataaatcataaaagcaaatatataacaacaaatgcataatcatttggtattgtaaaattatgtttcaacttctatctgataggcatgcatttaattcaacatgttatacatctattaatcaagttttatatgcaaaccttcatatataagtcctgtgggcagttaaatcaattccaaaaaaggttccaaagtatgagcaaatatttgtacagtacgcaacattatttaatttaccactctatatgttagctggaaataagcataggacattttgtttctaaccctttggttatttgccgccttagaatggagagggcatttatgaaataatttggataactctcctttctcaaaaagattgtctgagggcactggagtttatctcgataaatttctccataacaaggagggccagagacttgaattgcctcacctgtggtgtttaatgccttggaaatgcttgtagctcatgaacatgctctcttactgactttgtgatcatccctgataaaattgctaaaacaggcataagatgcttctactttcagttttgccatgaataaaaaccatgaagtgaaaaaccaagccaaaaacactgtgaaaatggagaagtgcgtccagatgaaagtcattgtttaaaagtcataagatgcggcttccgtgataaactagggggcgtcacaaaacagaggtttactagcttgtttgcatcctttaatttgaaagtcatcttttaaaagcaataattagacacagaaaggaacttgttctcataagacatcacactgattaattcactgtttacatgatcatttgcttttatgtaggtccaattaaaaagaaaagaaatatgagttattcgcttttaggaattaatttctgcttgcttcttcgggcaaaaaaaaaaaatttaatttctatggggcctaggtgctgtggctcttccctatatttccagcacttgaggaggctgagacaagaggatcacttaagcccaggagattgagaccagttggagcaacataataagattctgtctctacaaaaaacaaaacaaaacaaattagccaggcatggtggtgtgtgcctgtggtcccagctacttgggaggctcaggcatgaggatcacttgagcccaggaggttgcggctacagtgagctgtgatcatgcctctgcactccagcctgggtgacagagcaagaccttgtctccaaaaaaaaaaaactattgtcagaaaactcatttttttttgcatgtatttaattttcaccaattctacagtgtgttaacattaaaaattagttttggaagtttaattacctctgatgaccaaggcactcattagcatgctagaggccaattaattcacccaataatttaacagtttgttataccaataattcaaataaaactgtagtatgagaaacctacatcaaaaatgtatttttttgtctttgatgtttcctaggcctgtgctcctttatatcactggagaactcttaaaccgacaccagaaaaggacccagttggcacctgctatgtagcaattcagaacttcagcgcctatgccgagttctctccttgccggaacagtaagcaacttttattccttgaaactgacattagctcaagtgcttttctatcgtagacaggagtgcaggtaggctcaaaacaccattgataacttacagggttgcaaggaaaaagcttcgggggtaggtaaagatttttgtcagccttacaggtgtcttgatgtgacagcaagtcaaaagcgtggaattctactgatcttctgtgttttagaacatttctgatttaagatattttgcagaattgattggttccttattttaggccataaggtgtcagttgctgttcaaaattcacgttccgtgtcctaaagaatgctgactgcccactttacttgtttattgccaaaacggtgttagctagcatggttggacctgggcatatgttcaacttgagatttctgtctggcttgtgttctcaatggctgtttcttctttaccagctgtgtatgcagattgtctgcatgatatgcctttctgcttaagatgtttaatcctttttttcaaaatgactctgtatacttagagttcaaatctcatctggcagttctaggaatcttgcagccaagcagtctttaaagcaaacctgggagtgtcatctttggggcattgtgttttaatcactttatctctgttgaataccccagacttgggatagcataatggatggatggatgggtgggtgggtgggtgggtgggtgggtggatgggtggatggatggatggatggatggatgggtggattcatctactcagagtcctttaattaactcctccagttttcagtgtgccagatagatcactaggatttgttgataagatacctatggattttcattcttgttgataattcacaagaccatattggagggaaaatgtagtagaaagaagattctaggactgatttcaggaaattgacttaaagaaaaaacactaaatcccaaattagcttgagctctaaaatgtaaattttcccccttttgcctgagtgtttttaaaatttcaggattaatgtagggaagataatgatcaaatgccataaataaatgaagagaaaaaatcgattagtgatattagagggttaacaaagaggctgctgagatttagaagcctaaataacaggcagtagaaatttttttttttttttttttttgagacagggtctcactctgtcacccaggctggagtgcaatagtgtgatgatcatggctcaatgtagcctcgacttcctgggctcaagcaatcctcccacctcagcctgccaagtagctggggccacaggcatgtgccaccatgcctaatttttgtattttttgtagagaggggtttctgccatgttgtccaggctggtcttgaactcctgtgctcatgcgatccatccgcctcagcctttcaaagtgctgggattacagtcgtgcgccgccacacctggcttgaacatttaacctgatggcttttagtgaggatttttaacaaggagaagattattgctttctgtttaaaaatactgaggtaaatcagacacttcttcagattacaacaaatgtcagctgaatggatagtccatggaataaggattttattttaaatagctttaaagtaggggttctttgtagttcatgggactcaattatttattcaatgcaggatttctttaaaaagaaaaaccacacattgagcagtaaactaactcttctatgtttaggaaattcagcaaagaacaagagggaaaaagccccctgttcaaggaactgcctctagacagtaaacatgtaaataaatgtgtttatgatgcaatgtcaggcagtgaaaagtgctacaaaaaaatacagcaagacgagaaagaagggagagacctgtgctggggaagccaggggaggagcagcattttagacaagacgatagaaagggattcttctagcaaatgattattggaggagagaagagagaaacttcccggactcaggcaacaaccaacatgaggcatagtttgtgtcatgttccattcaaagtgctgtgctcttgggtttattaagaggtcagtattgttatgctaaagataaaatcccacaaacaataacaaaggatatccaaaatatatcagaaaatgaatggtagtggagagattcattattgaacttttcatcaatatttacacctgtccatatcctatactccatgatttgcccatgttcctgttctgtgatattgaccatatgctcatggacaagctggcttgttcaacaaacagcaaataactgtaactaaagacaagaccatccttcatatgccttttgccttgataatgtaggttattcttccaactgccttgaaggatgatatttataaaactagtcactccttgttctgcctttttgccagactacctgtgtgggatgtgagggctcagatcaaaatacagcacatgaaatgcagacttgtaggggaaaagtttcagagtgagtttgaaccatttttttaaaaagtacactaatgtacatttgcatcttaagctacatggacacagtagcctaacagctcaacaaagacagaatggagcacatgttgagttgcagaatagctcaataaattgccatgaattatttcctttgtggtgtatagccacagttttcacatcctcctggtctccctattcctacgggtacttcttcctcctcagatcatccaagaagcagacttcccgtcatggccaagaagttcacagatcattaacacaaagccagcttgttcatgagcatatggtcagtatcccagaacaggaaacatcagcaatattattttcaaaagagaatttaaagaagctcctcatgttaatcttataccgcaaacccgctctgctgatattgttagacattacctgctcattcatattgatgacctgcctatggctctcatggtcattcataattcaggtggagatggttcatacacacacccttccatttgttgggtaagacgtcaacaaatagtagcaaattatccacatgcttccttggattcctgagttcactctaggacataattatcaagttcacaaatgctctgaagtcccaggaagaaagagtccttcagctctcataaattatgattcaacaaggaaaaaaaaaaagactttgcaatggaaagaacctcacactctattataattgccacttacaataaacatttggagctgattattttctcagtgtattttgtaaaaaaaaaaaaaatgaatgttttctcttaatttttttcagcctgctgttttaaagcaatactttcaaagaatggtcatgtttcttccctttcgaataatttacaatcataaaaataaaaagtcagggttgaatttaaaagggatttttaaaaggcttgtgcatggaaaaataaatataaaaacacatatgaacacatatatgttcagagtaatatctcatgcattcatatatacttctggatgcatataaatatttacacatatgagcttctagaaaattgatacttagatattccagattatagagatgagcttttagggaactttataggattcatgaccataaatcatgaaatatagcggtaaaataaggaacaaattttgttaaaatacagtgcatgaggttaaaaagtgtttttaaaaataaaggactcgggaggctgaggcaggagaatggcgtgaacccgggaggcggagcttgtagtgagctgagatcgcgccactgcactccagcctgggcaacagagggagactccatctcaaaaaaaaaaaaaaaaaaaaaaaaaaaaaggagcatctggaaaaaattgatggtgacagcgctaaaactagctaactaatgaccaaaggaaagaaaaaaccggaagacattctaagggaagccggaaaggccaggtccatttcaaaaagcttctgaacaggcgcatgcccagtcatcaatatttcctgtgatgacatgtatttcctttcctgttctcttatttcagtttccattgaggaatatccttgataagaaagaaataattatttacatgtccaaatctaactatgcaggattgagattccctctacttaattcactacattttggctattttaggcatgttagaagttgtagaaactcttttaaagtacaagttacaagtagtaaattcctggtcctaatgccctacagacttttgataacaatagccttgaaatcaacgtgttggcctgcctatagcttacaactgtaccatgagatcctattggacaatgagttagtgaatcatattggatagaaagcaagataagccactactagaattttctcttttgtgaacactagcattgcaatgtccagtgagactgtgaccagaaatgcaatttcccaatttacctagcctattataataggataatttgtttttattattattttgtttgagttggagtcttgctctgtcacccaggctggagtgcagtggcatgatctcggctcactgcaacctccgcctcctgggttcaagagattctcctgcctcagcctctcaagtagctgggcctgcaggcatgcaccaccatgcccagctaatttttgtggttttagtggagatggggttcaccatgttggccaggatggtctcaatctcttgacctcatgatctgcgcaccttggcctcccaaagtgctgggattacaggcatgagccaccacaactggccataataggataatttaaaattaagttcctcttaaagagcgtaacagtggaaatgcttattggtggcccagaagatgacatctacaaaggtcatcttgcactgccccttcttcctcaaggtgtcaacttttgggaatgacagacctatctgccttcacacagcacgagggggcaaaagagagacacgttattgcctcatgggaaatttggaatatagtcaaagatagagattttatttcttcaaatgaaagtgagtcataaaacccaatagagtagccaaaagggatgttattcctgttgatcttactagagaatcacaacgctatttggtgtaagaaaatagacagaaatatgtttaataaattacttgaacaacattttaaaaataaacataaaacacatattgatcatttttaatttagaaggttctagagaaaataacataatatcctgaattggttattaaaaaatatttcaggaatgataacgttataacatttatgtattttgatcgttctaggcaatgctgatccggaaggccagggttactgccaagcaggatttagtctggatttttataaggtgaattattttggtctcgcagttcctaatatttaatctgatttttttttaccctctgcctctcactcccacaccccaaaaccaccaccaccaccaaagaaccaaagaatcttgaggaacatacctagcctgtttgggcaaatgctttctaaaaaaatttttccattcactttttatttttatgtaaataatttatgcacatagcggcctattaaatagtagagaaatagacatgataaaaagcaacagcctttcttctgatcctttgtggcaataattttttaaatgaaaatctaaaaaactcagtaatgtttcttaaaaagatcacatgaatctattcattgttttgttaactgtaattgaccagttacatttaatattaatattaaaattcatatatcctttcaaaaaattaaaaagagatgttcagtaagaatgtagagggaaaagattctgtggttttgaaaatagtatagaaaaatttcatcaacgtataaactgtttactgtcttttatcattctttttatcattacttttttgtttttatattttccactgagagttaaagatatgaggcacgaaaggtgaggatgtcaattcatgagaaaatgtttatatttgctagtctggagtgtttgctctttctcctgagaagggggtggcactggggatgtatggaaaaaaataggcattactatgtccttgaaataaattggaacagaattttatttctatcacgaaggctcaaaagaccatgtctgcaaaactgcacagcactaaacatgttgatattttgcttatgaggcagtgccaaaaaacagaatttatctctctcaagggagagagttcaacttacctaattgagtcaaattaaaattatttaatatgataacacactaaataattgaaaacaaaagaggaaagaaaatgaactgcaggcctccgaaggatctcttttaaaaattgctttttatgtgtaacaaattgttagagcaatgcttattaacaacaatttatcaccctttaaaaatgtttagtatttcttttccaattatggttgctgttgctgtttctgttttgtagaatggagaccttattgtgggaggacctgggagtttctactggcaaggtatgttctgttggcagacaagaaaagcacatttgttgttactaacagaaggatggacccagaagtagtgttaaatgtttactttctattaccttaattttatatccttattcatagtttctcaaatgaagcgttatttcttttttttgcttttaatattttattttaattgacaaaacaattgtacatatttatggggtacatgtgatattttcatacatgcttatgatgtgtaatgatcaaatcagggtaattagcataaccatcacctcaaacattgatcatttgtgttgggaacattttaaatctcttctagctatttaaaaatatgagataaattgttgttaactatattcaccttatagtgctatagaatgttagaacttattcctcctaccaggctgtacttttgtgtacattaacccatctctggctatacctgaatctctattcatccttgcctctagtaaccacttttccactctctacttcgatgagatcaacttttttagcttccatgtatgagtgagaacaaaagcatcatttcgatttgtactctcatttgttttctgttttttttctgagacagagtttcactcttgttgcccaggctggagtgcaatagcacaatctcgacccactgcaacctccacctcctaggttcaagcaattctcctgcctcagcttcctgagtagctggtaatacaagttcccaccaccatgcccagctaatttttgtatttttagtagagacggggtttcaccatgttggccaggctggtctcaaactcttgacctctggtgatccacccgcctcagcctcccaaaatgctaggattacaggcctaagccactgcccagcctgtactctgtaatgtaaataatattttaaaatactcttgcaacttaacaattcatttctccatcaacaatgtgttgaggctctgccaagctctgtggtagaggctggggacacattaatgagtaaaaacagacattgttcttactgtcatggaggttagtatctagagaatgataacaggcattaatcgaactgtcacaggggtacccaagaaaccccaactgtgatacacaatccgaagcaaaggcatgtggtgatggggctgggagaaattaggaggcttctcctgggtggctgtggacaggtgtgttttgtcctctgaccactggctgacagggagctggaatacaacctgtgctctgcttatggagccatgaacccaggtacagacagcatctgctgagaggaaattacgtcttctaattcttgctaaggtgctgcataggccagcagcaacgcaaagttaacttggaaagcaaacaaccctgaactgagatctggaccttacgtaggagtacctaggtgaagagaagagggaccacgtgcagatgtactgtgggaggcaggagggcagcgtaggtgagaatggaggaaagtcaaggtgaccggagttaagagagtgagggaagaagagcttgggtggtatggagtggcccgctaatttcacaaaagaatggatgatgtgaaattaacattattatgttaataaaaaatttatcataaattttcatgatatttttaccataaattatgttaatttcacatcatccattcttttggttgaaaaaacgtaggatacaaatgatttgctgaaaatttaccatagcaatggcatatacaagcatttgtctgagacatagaaatttaaaattttattcaggtttcacattgaaggcttgcagtccatgctaagcagttttgtctttattctacaaactatggaaaaccactgggggattttaagagtttaaatagatggctttagctagagtaagaagatgttgtttgtcctgagtgtagtgacaaactatgaagtgagtttaagcatggagtgctacaatcaaattatgttttgaaaggatcattctggctgcgttacagaaaatagattgaaagttggccaaggtgaaatatcagcaaagtagttacaaggttgttacaaggatataaactaattttaagtttataaggtaaacaagttgtataagtttcaggtaaagttgtctgtttcttagagcgatggtggtactgactgtaaaagaagagaaatttgagaaatactttggaggcaaaataagcagcctaaatgatgggttggatatatgctggtaagggaagaaaggtggtaagggagtgtttctgacgcctgctactgaatggctgtaggtgggtgccgctcactgagatacagaacactggaagaggaccagtttagagtggcctggagagggaagatgatgagtttacttcttgttctgttgtgtatgaaaatatttgagatacccaaagggtttcacctaagtatttagggcttaagcccagagaccatctagagtgaaatataaattttcatcacttcatactggtgataactcagtccatgggtatagatgggaggcctagagagagaatactgagaagattctataatttgggctataaagtttaggacagagtagaatctgagattaagagttgagggaggaatttttttaatggaagaaacttgatcatgtttaaaagtcattgagaaagatccaggagagatagatttatgatttttttttttttgagacgagtctcattttgttgcccaggttggagtacagtagtgtgatcttggctcactgcaacctctgcctcccaggtttaagtgattctcctgcctctgcctcctgagtagctgggactaaagttgcatgccaccacacctggctaatttttgtatttttagtagacagggtttcacaatgttggtcagactggtctcaaactcctgatcctggtctcaaactcatgatccgcccgcctcagcctcccagagttctgggattacaggcatgagccaccacacccagctgatttatgataaaattgtatataaacttaatgttaagctcagttcatgcatatacaattataaacatcaaacaattaacattttggtatttaaaaactactctgcaaactgaaaaactatatattttgcacaacagatggctacaaaattaaaattatatttacggaaggttttcttctaattcacttggttaatttcacataatccattcttctccttaaactgaaaaaatgtctgagacaaatgatttgctaaaaatttgccatagcaatggcatatagaaacatatgtttgagacatagaatttaaaattttattcaggtttaagatgataatgtgtatatgtgtatagacatagctaaaggaaacagcaaagacagtgtgtatgtgggatggaggaaagagggtatttagctgtaacccagagacaactggcaaattctacagacagtgttcagaaactcatgtgtaaataccatggtcttaatatcagaatagtcatttcaagtcccagtcacttggcaatatttatgatctagtttgacagtttcattcttttgtggacttccaacagaaagactgtgggaattttgtgtgaattcccaaagactaatttggctttcaaattaatgttaaatgatagtcttttgaacgcatttcttcagttttctgccaaagagcatgatatcacacttttgccttagatgtccatggtaaacatgggaatgcatagaaattgcagcggaaattgctggttgtcttttagatacttgtctaccccaaggcaatcgtatttcaagacttctgacagtgacttttgagagagattaaccaaagttcttatcacgtcaatgttggtgcccatggatttctcttttgctgaattttggatctcattggacctagctgcttcccattgtcctaattttatgctctctctatattttagcaagaaaagcagatggctcaaagagtttacaattccttcatttaacttagctgatatattttatcatctattaatcagatatgtgatttagattgaatacagtatctatgctttgcaagagcacaaaatgttttattagaataccaaaggaaatgttggctgtaatgcctgttagcaaatatcctattagcaaaaccatatgaccttagagaatgcactgtagctctttgggcttcagtttctccacctagaagaagctatatttgaccaaatgatctcaaagcttccttccaggtggaatattccagaataaaaattacatcatggccgggcgctgtggctcacacctgtaatcccagcactttgggaggccgaggcaagcagatcacgaagtcaggaatttgagaccgcccttgccaacatagtgaaactgcgtctctactacaaacacaaaaaattagccaggcgtggtggtaggtgcctgcagacccagctacttgggaggctgaagcaggagaatcacttgaacccgggagacagaggttgcagtgagctgagactgcaccattgcactccagcccaggcaatagtgcgagactccgtcccaaaaaacaaaaacaaacaaacaaacaaacaaacaaaaattacatcacataaattttacttgcaaatttggcctccactcttggatacttttatcatttggaggtggagtgtgtatgttaaaagcagcaggaagaccaataaaatattgtagttcatctcaggtcttctgtcagaatggaaagttctacccagctgtaactaactctgccttggagtttgagcggcaggcgggaaaattcatcatcaaaaaagcaagcaattccaccatagctttcaagggaatgtgggtctgctcatggagggcctgcctcttgctttcattcagttaacgtattaatttgtttaaacacaggacaagtgatcactgccagtgttgcagatatcattgcaaattactcattcaaggatatcctcaggaaactggcaggagaaaagcagacggaagtggctccagcttcctatgatgacagttaccttggtaagacccattgcccaagacatttgtggtttttcaaaagacaagcatagtaaatgtagatgcaagttttatccctgacttatccgatgttatttggcatcttatacaaatgttctcttattagagtggactcaatttttcttttctttttaatactgctatttttccagccgcgatgtgtaatacataatgtgagcagctattttgttggctccatagcagttttttgcacatgaactatttcaccagtagtagatactatgtattagcagggctgctaccagtgtgacagggacaggatgatagcagccttcttagttaacagagacgcacaagagaagtttgagttgctggaatattctcaaattatattatgcacaaaccacacaatgtcatttcaccactactgtttcccaactttggttcctagtggccatttgattgcttgatgaatttgaaaaagaaatgtagctatgttttgtcaatgtagccagcacctcactttagagctaaactaaattgtggaaaaccatcatgaggtattaggaagtaggtcttactggtgaccagaaatagcaaaacctgagcccaaaggaaatctttcagagtattctgtctcattattttcaatcagcagctcttaaaatgcaacagccaccatttactctcaaggtggattatgaagtatccatgcttttaaaattgacctcagaatatctccctcttttttttttttttttttttgctttgctcctacttaagtagtagataatctattatgcactcaggacttagtataaaagtgttccttttggtgtgattaatttttccctttatagaatctttaacttttataatatttgtagaggtttctaaataaagcagtaccatggtagccctttcacctttttctagatataactcattaggttaagtcattaagtgtgattagtttctttctttttctttaaaacaggatactcagttgctgctggggagtttactggggattctcagcaaggtgagaggcactgttgagtttaaatcacttataaagcatggggaaatggtaaaatggcatgtaaagttttttctatcaatgtgattttatttgctataccaaagggatattaatggagtcccagagtgcctatactttgtagaaaaaatactttgatacagcattttaagtctgaaagaattttgtaagaatgaatatcaactttataaaatctagttaagcaataaaatattagggccataatcccatgttatgaatgaaaaatatagatgactaaatgccatactgttagtgacagatcaaatttgtgaaattaagatcccttcatttctagtacctctcatattggacatgtccaaaattactctccccaacgaactccaatccaacaccccaaccttacttgctttttcctcttttaacataccaaaaccccaaataacaaaacaaacgaatccctatctcctgtatatcccttctgtcctgtcttctctgctttgctgtggctgttgtctaccagggctgatggacatgaaataatgaacacagaatacctaattaaattatgataagtgctaggataaaattctaaacatagagtaagaaaagctgtggtgttaagaaaacggagcctgggatgatgacggtggggggtcagacagacaaaggggcaggggccaacttctatattctaaggtgtgtagaaaatgcgggtgttgaaggacctcagcttgactgccagactttgatagtgaaacgagattggcttcgagcaaagtctgggctcagctcatgtccggttttacgggtcatggaaacaattctgggatctattcaacgtgcaggggagaagacatgaaaggtttcagctgaggagtaaatataatgcaatcatgcttgtaatctaaaagaaaaaaagagaacaaatcacactggctgcctatgtagatttgattgagatgagagtaaggaagaatggtatcacatatatcacttttctcttcatgtctacctccttgaaggcaaggtctatgtattgttatgtattgttattatttatctcttttacaaagactagaccatgtgttgctcgtaatagattcataccggaaacagcttgacagaaataatttgaatctttggagtcaagatccacgtaggttcaagttctgacttcacactctctattccttaggctatgacaacctctctggttcttatttgctcatctttaaatgacactaatattaactaactcaaaataatgttctgaagattgcatgagctaatgcatgaggaatacttagatacaaggcaataaatgggagctttcactcaacgggtaatatttattgaatgagtcaatcatcaatcagtatttaccattttccatcttgtttcatatgaacactgactgcatttcactaatgcaagtggtttaattcacaaataattaagagtaaatggagttgggagccaagatggccgaataggaacagctctggtctacagctcccagcatgagcgacgcagaagatgggtgatttctgcatttccaactgagctttgaagagagtagtggttctcccagcacgcagcttgagatctgagaacgggcagactgcctcctcaagtgggtccctgacccctgagtagcctaactgggaaggaccccccagtagcggcggactgacacctcacacggccgggtagtcctctgagacaaaacttccagaggaacgatcaggcagcagcatctgcggttcaccaatatctgctattctgcagcctctgctgctgatacccaggaaaacagggtctggagtggacctctagcaaactccaacagacctgcagctgagggtcctgtctgttagaaggaaaactaacaaacagaaaggacatccacaccaaaaacccatctgtacgtcaccatcatcaaagaccaaaggtagataaaaccacaaagatgggaaaaaaacagagcagaacaactgctaaaaatcagagcacctctcctcctccaaaggaacgcagcctctcaccagcaatggaacaaagctggatggagaatgactttgatgagttgagagaagaaggcttcagaagatcaaactactctgagctacaggaggaaattcgaaccaatggcaaagaacgtaaaagctttggaaaaaaactagatgaatggataactagaataaccaatgaagaaaagtccttaaaggacctgatggagctgaaaaccaaggcacgagagccacgtgacaaatgcagaagcctcagtagccgacgcaatcaactggaagaaagggtatcagtgatggaagacaaaatgaatgaaatgaagcaagaagagaagtttagagaaaaaagaataaaaagaaatgaacaaagcctccaagaaatatgggactatgtgaaaagaccaaatctacatctgattggtgtgcctgaaagtgacagggagaatagaaccaagttggaaaacactctgcaggatattacccaggagaacttccccaatctatcaaggcaggccaacattcaaattcaggaaatacagagaacaccacaaagatactcctccagaagagtaactccaagacacataattatcagattcaccaaagttgaaatgaaggaaaaatgttaagggcagccagagagaaaggtcgggttacccacaaagggaagcccatcagactaacagctaatctctcagcagaaactctactagccagaagagagtggggaccaatagtcaacattcttaaagaaaagaattttcaacacagaatctcatatccaggcaaactaagcttcagaagtgaaggagaaataaaatactttacagacaagcaaatgctgagagattttgtcaccaccaggcctgccctaaaagagctcctgaaggaagcactaaacatggaaaggaacaaccagtaccagccactgcaaaaacatgccaaattgtaaagaccatccaggctaggaagaaactgcatcaactaacgagcaaaataaccagctaacatcataatgacaggatcaaattcacacataaaaatattaactttaaatgtaaatgggctaaatgctccaattaaaagacacagactggcaaatcgcataaagagtcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatgataaaaggatcaattcaacaagaagagctaactatcctaaatatatatgcacccaatacagaagcacccagattcataaagcaagtccttagtgacctacaaagagacttagactcccacacaataataatgggagactttaacacccccctgtcaacattagacagatcaaatagacagaaagttaacaaggatacccaggaattgaactcagctctgcaccaagtggacctaatagacatctacagaactctccaccccaaatcaacagaatatacattcttttcagcaccacaccacacctactccaaaattgaccacatagttggaagtaaagcactcctcagcaaatgtaaaagaacagaaattataacaaactgtctctcagaccacagtgcaatcaaactagaactcaggattaagaaactcactcaaaactgctcaactacatggaaactgaacaacctgctcctgaatgactactgggtacacaacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagtgagagcaaacacattcaaaacctagcagaaggcaagaaataactaagatcagagtagaactgaaggaaatagagacacaaaaaactcttcaacaaattaatgaatccaggagctggttttttgaaaagatcaacaaaattgatagaccactagcaagactaataaagaagaaaagagagaagaatcaaatagacgcaataaaaaatgataaaggggatatcaccaccgataccacagaaatacaaactaccatcagagaatactataaacaactctatgcaaataaactagacaatctagaagaaatggataaattcctcaacacatacatcatcccaagactaaaccagaaagaagttgaatctctgaatagaccaataacaggctctgaaattgaggcaataatcaatagcttaccaaccaaaaaaattccaggaccagatggattcacagccgaattctaccagaggtgcaaagaggagctggtaccattccttctgaaactattccaatcaatagaaaaagagggaatcctccctaactcattttatgaggccagcatcatcctgataccaaagccaggcagagacacaacaaaacaagagaattttagaccaatatccttgatgaacatcgatgcaaaaatcctcaataaagtactggcaaaccgaatccagcagcacatgaaaaagcttatccaccatgatcaagtgggcttcatccctcggatgcaaggctggttcaacatatgcaaatcaataaatgtaatccaacatataaacagaacaaagacaaaaaccacatgattatctcaatagatgcagaaaaggcctttgacaaaattcaacaacgcttcatgctaaaaactctcaataaattaggtattgatgggacatatctcaaaataataagagctatctatgacaaacccacagccaatatcatactgaatggacaaaaactggaagcattccctttgaaaactggcacaagacagggatgccctctctcatcactcctattcaacatagtgttggaagttctggccacggcaatcaggcaggagaaggaaataaagagtattcaattaggaaaagaggaagtcaaattgtccctgtttgcagatgacatgactgtatatctagaaaaccccatcgtctcagcccaaaatctcctcaagctgataagcaacttcagcaaagtctcaggacacaaaatcaatgtacaaaaatcacaagcattcttatacaccaataacagacaaacagagagccaaatcatgagtgaactcccattcataattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattttgaaaatggccatactgcccaaggtaatttatagattcaatgccatccccatcaagctaccaatgactttcttcacagaattggaaaaaaactactttaaagttcgtatggaaccaaaaaagagccggcttcgccaagtcaatcctaaaccaaaagaacaaagctggaggcatcaccctacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactcattcccttccttataccttatacaaaaattaattcaagatggattaaagacttaaatgttagacctaaaaccataaaaaccctagaagaaaacctaggcaataccatccaggacataggcatgggcaaggacttcatgtctaaaacacaaaaagcaatggcaacaaaagccaaaattgacaaatgggatctaattaaactgaagagcttctgcacagcaaaagaaactaccatcagagtgaacaggcaacctaaaaaatgggaaaaaatttttgcaacctactcatctgacaaagagctaatatccagaatctacaatgaactcaaacaaatttatgagaaaaaaacaaacaaccccatcaaaaagtgggcgaaggatatgaacagacatttctcaaaagaagacatttatgcagccaaaaaacacatgaaaaaatgctcatcatcactggccatcagagaaatgcaaatcaaaaccacaatgagataccatctcacaatagttagaatggcgatcattaacaagtcaggaaacaacaggtgctggagaggatgtggagaaataggaacactttcacactgttggtggaactgtaaactagttcaaccattgtggaagtcagtgtggcgattcctcggggatctagaactagaaataccatttgacccagcaatcccattactgggtatatacccaaaggattataaatcatgctgctataaagacacatgcacacctatgtttattgcggctctattcacaatagcaaagacttggaactaacctaaatgtcctacaatgatagactggattaagaaaatgtggcacatatacaccatggaatactatgcagccataaaaaggatgagttcatgtcctttgtagggacatggatgaaactggaaaccatcattctcagcaaactatcacaaggacaaaaaaccaaacactgcatgttctcactcataggtgggaattgaacaatgagagcacatggacacaggaaggggagcatcacacactggggactgttgtgggttggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaatgtggaaaaaaaaaagagtaaatgaaatatggtcacctctaggaatcatcacagatcctttcatagtttcatgggaaggtatacaaagcagaaaatcataaagttttgcagttcaggttgaagataatcaggttttattttttcctttgaaagaacatttttcttttaggtacaaactaattcataaaggacttgtcctctcattatgtcttcttcaaggtattaaaaggcagtatattgtaacgcttaagagtcctggactctggagccagacctcttgggtttaaaccctgacctcacttcttactatctctgtgaccttggacaagttaccaagcatcttagtgcctccaaattttttcattcctaaaataaggatgatgagctaatagtattgtctacctcctaagattcttctgagaattcagtgagttaactctgtgtatccataaaacagtgcaaggcctgatatctaaaaagtgctgttggctgttacaagaaccactgaattaggaaccaaagatagtattgagtaactagcgccttgaaaaaaggtcaaatctaaaaatcactaaaaattttacaaaggaaactgtaaaacatgccaaattattattttttttaatgtggcattaggagtattgttggactgggtgtggtgactcacacacctgtaattccagcactttggaaggccaaggtgggagaattgcttgagctcaggagttctataccagcctgggcaacacagtgagacctcctctcaaaaatacaaaaattagctgggcatggtggcatgcacctgtagtcccagcttaagaggctgggaggctgaggcaggaggatcacttgaccctgtgaggtcaaggttgaagtaagtcatcattgcaccactgcactctagccttgggtgacagactcagatctcgtccaaaaaaaaaaagagtcttgttggaaagctctcaagaatagcattcagttttgacccaagaaaataaataatgatgcacaagagtatattgtagggaaagatggtagaaaacagtagtgattttccatcagatctcagaaatatctgaaaaatggattgggttttaagtgttttgaggatatctaaaataaaaggatattttgtgttttgaggctatctaaaatatctaaaataaaataaaaagtgttttgaggatatctaaactagttaaaataaaatatctaaaataaaatatctgaaaatggattgtgttttaagtgttttgaggatatctaaaataaaagcactatcaaggaacatcgcaatcagctcaccagaccactacaaatccaggactgtgcatgttcatgatttacttaattagacaacagggaatgagaattctattttaaaaaacagtgagcacttcaatgtcctctagatgatgggttcttaatatggatcctcacactgctaggtgggacatgcataggcctcactggatcggaacccctaaaaattacatacaatatttaattgtgtataatttttcttgtgagaggatccatagctttcttccaattttcatacacgttcatgactcaaaaaaggttaagagcctttgttgtcactttagagtgaggtgtagtgagctaaaacccaagaaagtaatctgttcctaaccaattccaggaatgtaatttgatgtgttggaaagaatgttgactttgctgtcaatttttgacttgtactactcaccaactatgagttcaatggtgatagaacctttctaagctgcaaatgaaggaaatatttttgcttctcactagtcaggatgctactcaagtcatgtgttcctaggtcaaggatctaaatttttcctgattatattgattattaaaaaccttctggccatgtacagtggctcaggcctgtaatcccagcactctaggaggccgaagcaggtggatggcttgaacccaggagtttgagaccagcctgggcaacatagtgagaccctgtctctacaaaatatacaaaaactagccaggcacagtggcatgtacctgtggtcccagctgttcaggaagctgaggtagaaggatggcttgagcccaggaggttgaggctgcagtgagccatgatgatcatgccactacactccaggctgggcaacagaataagaccctgtttaaaaaaaaaaaaaaaaaaaaaaaaaaaaggaccttctgaagatttcaccttgagttattgaaaaggaaaagtctcctattttttcttgcaactgaatattttttgtagttgagtgacagttcaaacttgccttagaccccaagcaattaagctgtcctgatcacttattaaaaaattaggaggatctttactcaatattacatttaataactccttagagttgtggtcacatgagattgcagacttcacagttactgggtgggagactgatactttaaaaacaaaattcccgatgtttgtgggatgggaaaagttgtggttgccatgtttctcaaatggcccaatcctctagaatctgtcctcacccacaggcctgaccctgaaatcagtcaaccctattatatctgattgtggtttgtttttagtgtcaggagaacttaatttataccaaataaagattattgaaaactggacagggtactaccagttccgtcaactttcctggcagtctctccagattgcttagtttttctgaaccctgttttatgattcaagagcatgcttcccctgccctcctactgctgtagatgaatcatccacgtccctgtccaaggctcccctctctgcttcgcacccattccctcccttgactctgagacggaaccagaactgtaatttttatactagtacaaaagatgtcactatagtaaaagctggaagaatcagagtaagaagtctaatttataaatcacacgcagactcaagaagccagattcatgaattagagaccgaagtacagagagactcgtaatgaagacataaagtatgacaaagtatgacaaagtatgacttctgtttttctgttttctattatctggagaagaaacaaaagctaatggaacagtaaacgcaaagccctggcttcaaacttccaaccctctacatcagcaatccgcaaccgttttggtaccagggactggtttcacagatgtgggggtgagggatggttttgggatgaaactgtttcacctcagatcatcaggcattagttagattctcaagaggcgtgcaacctagatcccctgtgtgcacagttcacaatagggttctcactctggtgagaacgtaatgccaccgctgatcagacaggaggcagtgctcaggctgtaatgtaagcaaggggagtgtctgtaaatacagatgaagcttcgttctggctcgcctgaggctcacctcctactgtgtgtgtggccgggctcccaacaggccacagacaggtgctggttgatggcctggggcttggggacccctgctctgtatgatagccactcattttacaagcactgtctttaccacttttagtatatggcgtgtgtgtgtgtgtttgtgtgtgtgagtaattccccttctaaatggctattttcatccccagaattggttgctggaattccaagaggagcacagaattttggatatgtgagtactgagaatgcattacaggaatagggtattttcttgtataggtgctccttgatggaattacatctgaataaacccatcataaattgaaaatactgtcagttgaaaacacacttaatacacctaatccaccgaacatcatagcttacctaacctaccttaaacatgctcagaacacctacattagcccacacttaggcaaaagcctattgtataatgaagtgttcatatctcaagtaagagcatcatatcgcatattgctagtctgggaaaagatcaaaactcaaaattcaaagtatgattattacagaatgtgtatcacttttgaaccattgtcagttgaaccatcataattgaaggaccatctgtatacgcaaagaaatgtttcattttatgcaaattttaagtcttttaaaacttcctttatgaaggggttcttcctcccgattcatgctgcttgcttacggaaaaggaaggaaaataagtcagattagatttcttctgatccatgtgcaggagcagctacttaactgatgagacctagtgcaaaatgaaaacacagaccccttgttcataaattattaaaaatttcaggacatgaacagcagaccattaaaccaagggtgagacccatctaagcacagggtcctgtgtgactgcacaagtcacatacccacaaggctggtcctacctgtgggtataatccgggaataattgtggaggatgccatggttatgatcagcaacttaatacgcctcatacaatagaaataaaagcaattgttatttcagttattttaatgaattgcattattttattataaatttaactaattttaaatttattatttgtttccatgactgctataacatagaatcacaaactgcctggcttcaaacaacataaatttattcactcacagttctggcagccagaagtctgacatcaaattgtgggcaggacaatattctcaccagagcatctatgataggagggttctctgtgcccccttccagcccctgatggtccctggcattccttggcttgtggcaacatcccaccagtctctgcctccatcctcatgtggccttctgccctctctgtctacatgtgtcttctcctcttttgataaggacatcagtcattggatttagagcctacccggatggtttcatcttgagatccttaactaatttcatctgcaaagatcctatttccaaataaagtcttattctgatgttctgggtagatatgaaattttggggtgctactattcaaacccattattatgaaattaggaaaagcaaataaatagatcttctgaaagaaaaacattttaaataaagttcatcttttacaaaagtatctagaaagcatcacggttgtctaagtagaagtaaaaggaatatttttgccatgtggatagcattttaaaatctaatttttcttgcaaagaaccataatgatcaatttatcatagaataagaacagaaatggatttggacaaaaatcctgactaaatcaactaatcatcaagttaattgctctcagtattcttgaattcaacttttatttctccagttcagattaataagcgtgcgttttttctgaaagcatcccagacttaaccataaacaaaaactttaatcggctttttttttttaaaataagatcattccgtgggctttcatttttgttttacatttagctaaccatttatcacactttacaaaaaattttaaatgattcaagttgtagtttttaaaaaaggctccaattctatggcaaatggtgtaacctgtttaatttctgtgatttcaggtttccatcattaactctacggatatgacgtttattcagaatttcacgggagaacaggtagagacattttaatatcaaataaataaaatcactctgggttaccagtagactataatattcatatcagttattcatccatttgacaaatatttaatgagcagctactacgtactggaaactgtcctaggcaccggggatgcaatcatgcatcagacagacagatcccacccagctctcaggcagcagtgaggcggcaggggagggagaggaagggacagtttattaacaagcaaataaatgtccatgataatttcagattgtgaaccatgatttaaagaaaataaagctgagtgatataagacaggagggaagtggcaaggaagcctttggatggggtgatcaggaggcctctgaggtgccaatgtctgggctgagatgtgaatgacaagacagagccaactataccatcttatccagaaccttccaggcaagggaaggctaacaagaaggctttcaaacaagaaccagccagacatgtgtgaagagcagagtgaaggccacagtctctgtaagcaagagagatgtaggagctgaggacggaggggacaggggctactcatgggagactggtgggggaggtgggcggtgtttgggattaagaatttttttctaagaacaatgggaagtggtttcgtattaacatgaatctttcaatagtctataaaggcctgaaggttttgatgtaagatatgggaagaaggtcactgtaaaaagggcctggacttctgcagctgacagattagacttccagttcccaccgcaccgctcatgaactgtgtgagaccacaggaaaatcatctgacctctttgagccacttggcaaaataagaataaaatgtttatcttccaagctccctttaagaatgaaataaatcaaggattgtagattacttagaagattccctggcacataacaactcctcaagaaatgttaattcctttccatcccatttcctgtctcctgccttttgatcaaacaaaagccactaaattcccatgtgccattaaatcttctataatttgagatgcatgcgaatacgtgtgcttatgatgatcataaactattgcatctctatttcagtaagatatagattcaggcctccatgtttgaatgcaggacaaatttaaaataaatgaattccttgtgtttgtaacttatatgtgactatttacaaacagaactacgcacttaattttaaactaaatatgaacaaagctgtggaagtaatacatttaaaactaaccatgttaattaaatttgaagaggagagaaaaatcgattgcctggagaaacaaattcagttcacaactggcttcctttagacggaagcaccaactcagtatttaaagaaatgtggctcatacctgtaatcccaggagtttggaaggccaaggcaggaggatcacttgaggcctggagctcatgaccagcctgggcaacatagtgagaccactgtctctgttaaaaaaaaaaaaaaaaaaaaatgaaagaaaagaaaaagaaaccagcaggttttaaaataaacaaaatgattttgacatctttttgctgtaatttggggctttagtctattactctgaaattttcagcgaagcattttatatctcctgatattcttttggaaggtttggagaaataagactgagatgagcgggaagttgaatagatattgaactgtttgaaacaactattcctaagtggtggtaattaataagtgaatgagaatctagcaatgcttctcctttgctcagatctgtttacttttcatcattagaaactttttaaacattgctaaatttagtctttctataacttcctctcctcaataccacctagttctgtaatcctgaacctcagaaggtgataaatgatgaaatttcataaatgatgaaattcctctgagtaaaggccacacaccaccacatcaagagaaagaatttcactatctatgtttggaacagagaaaagaggtgtgagaattgagttgttacatgccacttgttaactcatgtattcattttctctgcaaagagcatttggcacctggcacctactttggtccagacactgctcagaaagttcagatagaacagcaaacaaaacagaccaaagtctctgcctcctggggcgtgtgctttctaagggattgcatgttcattaaatgaggacacgatggaagctacgtcacttcaaacattgcatggcacactatggaagcaaactggcaacctgaaactatgggtcaaatctggtgagagcataaatcctgaaaagattataaatccaaaaacataggtttaaaaagaaaaactgcagcgataaaatggggagaggccaggtgcgggggatcacacctgtaatcccagcactttgggaggccgagtgggtggatcacctgaggtcaggaattcaagaccagcctggacaacatggtgaaacctcatctctactaaaaatagaaaaattagctgggcatggtggcaggtacctgtaatcccagttactcaggaggctgaggcaggagaattgcctgaatccaggaggtggaggttgcagtgagccaagatcacaccactgcactccagcctgggcaacagagcgagacttcatctcaaaaaataaataaataaataaataaaaaagtggggagactatggtacactgtgtacactcatggaaaagatttaggagcttttgttgactatgagcacgatacaaattgatactgagatgtgggttcccccgacatgaaaactttttatgcttcctctgaagcaggaagcgtaaatcttacctaactcttctcttgtcatcagcgcactcacaagtgtcatctgtgttttggtaccacatgtcatatctctaacacagagagtttggatggtgaaccaagtgacaatattgtcttttgagacagggtctctctctgtcacccaggctggagtgcagttgtgtagtctcagatcactgcagccttgacctccccaggctcaggcgatcctcccacttcagccccacagttagctgggactacacgtgccaccatgccctgctaattctgttttattttttgtagggatgaggtctcaccatattgccagggttggtcttgaacccctggactcaagtgaccctcttgcctgggcctcccagaatgctgggattatagacataagccaccacacccagcctgaaaatattttcatacaacatcatatggaattggaattagattccttctgtgagattcaagattgcagaacttggtgggattaagtgctagaagttatggaagagccagatttagcagtgaacattccgatagctgtgtccacagattaaatgggctgattgttgaacatccccagaggatgtccaagcagatgtcagggttattatggggaaaattattcactgggtcaggggttagactaaatgaggcaaaaagaccctggccacttcgaagaatctatgaatttcaatgcaaaaatgtaccacaatgagatgaatctttcaggaataatagagacatgactacaaaaatgactttttggacacaaaatgtcatctcctgattttcctttgcagatggcatcttattttggatataccgttgtcgtatcagatgttaacagtgatgggtaagtttatagacctctctcatatacaatatattacattcatccataaagatgttatgtttttccttcacaaaatacacccttccttattgcctcaacaagatagaggctctcttgttctcaacttttttggttcaagacaagaagatgcatctactaaataattctctgtcatctgattttgtccttaaggagattttccacatctgctgcttctagaagaggactattttatttcgttttatttttaattttataaagtcttcagccattcaaaattcatagccattgagaacattcatctatctctcttcactcctagaattttcccctagcatgtgatacattcacaaaacatttgcacataaacggatttttaagttgctttaaaaatgtaacagccatggagaagacgaaattgttatttttcagattacagtagtaaattacagttgaacatggaccaaacagcacggtgaattttggttgtgcttaagtcattacttcaaaaataaattatgattaaacacttctttgattcactaaaaggacctgacaggtaaattaatgaatcattaaattaaaaaccattagattgagatgtatcaattatccacccaaaaatattattggatcacacaccacgttccaggctttgttcttggtgcccagaatacacaggtgaataagacagatgtggtctctcagggatctcacattttcacagaaagcaaatatctgaagaatacttactttgttctaggcaacgggctaagcactttagctatacttttgctagatattttatgtgacctttatatagctgtcaatggactttgtgttaattgtatcatggcatttgactggagataaatttcataccttttgtacctgctgggaaatatctttctattattctttcattgaacataaacttctcaaacatctactgtgcactaacaggcactgttctaggtgcagagaaatccataacttcatgaagattatactagagttaggaaggttgctgctacagacaaaaattaaatgagtaaagagtatgttagatggttataagtactgtggagacaacgaaaacaaaaggaccgaaagcaaccaagtagatgaatatgtaaacaaattctggtacatcctgataattcagttttattcagtgctaaaaaagaaatgagctatcaggccatgaaaacacacagaggggccgggtgcggtagctcacgcctgtaatcccagcactttgggaggctgaggcgggtggatcacctgaggtcaggaggtcgaggccagcctgaccaatgtggtgaaaccatgtctctactaaaaatacaaaaaattagccgggcatggtggtgggtgcctgtaatcccagctacttgagaggctgaggcaggataatcccttgaacccaggaggcagaggttgcagtgagccgtgattgcaccactgcactccagcctgggcaacagagcgagactctgtctcaaacaagaaaaaaaaaaaaaagaaaaaagaaaagaaaaaacacacaaaggaactttaactgcatattgctaagtgaaagatgccagtctgaaagatctacatgctatatgattctaattctatgacattctggaagaggcaccactatggcatcaggaacaaggcagtgtttcccaggggttctgatggagggagttatgaacaggtgaagaacaggatttttagggcagtgaaatgactctgcatgatacagtaatagtggatatgtgtccttatatatttgttaaaacccatagaaggtttgataccaagtgtgaattcaatgtaaaccatggcctttggttgataatgacgtatgaatgtaggcttattgattggaatgaacgtgcccctctgatgtgacggtgtggaaggttgcaagttagggagagggtaatgggagaactctgtactttctgctcaaatttgctttgaatctaaacaatctaaaactgctctaaaaaaaaagtctattaattaaacttgttaaaatagagaggagagatagggagtatttgaagggatacaatccccaactgggtagatcatgaaggtctcagggttaagagtccagctaaggaaacacctaagggaggtgaggaccagccatggtgatctaagagggagggagggaggaaggagtgttccctgtggaagagcaaaaggtgcgtattccctgaggtgggagctccaggcatattcaagaaccagcagagagctgtggagcgtgaaccctggggagctgcatcatgaaggtgtgcaggtcactgcatttactccaaactgccacacacagtgcaacacaaactctgccatggactagaacaagtccatttccaagaaggctacaacgtcctgtgagccatggggattccaggtgagcagtaccagctcaggcttcgctgttatcagctgtgctctgtctaccagctctagatggtcacagagccttctggaaccctactaccatgcaccaggggaggcaggacagtggcttggagggcagtggaatgactctgtatgagcaatagcagtggagggagattgcagtgcttgctctctgcatgtatttcgaagttatagttgaatgtcaatcttatcctgaaagcagttaatttaaaaataaattgccttcatcttcagttatctaagttgtaaaaataaagtagctattaggacggtcattcaagatttccaacttaggtggactgtaattgtaatcaaagccttttagtcatttggaaagaaaatagctaaagaacttgaaggccagacatagcatgccgtccagttttcataacgcttacaaaaacaaggtttcttaaaaagctccaaaatctcaacatcagggaaaaaaaaaaaaaaatcccactgtggcctttcagatatgcacagacacatttcttcccactgacggccacacaacaagcaccaggggctcttcccctgctgcacggattcattccatgtgttctcttccacaggccactcctgttttgaatcctcaggactttgcccaagcttcgccttatgccctgcagggcaccgtccttcttggaaacatgcgcattctagtctatagcaaagttttgtgagaatgtttatagtactttttatttgtcatgttaaggaaaaaacaaattgtgagaaaaggacctcattggcttcctgttaatcgaaacaacatggtagtaacaaacacagaactgttataaagtaataatttcttctttcttgaagttcttaaaaattgctatgcatactatttttttattacgtagtattttctgaattctttagactgcattgaaggatatttccattaatttactaatgccgttcataaagataaggtgcccacagattctcagtatatcacttgctgtttttaattacttagatgctatgtaaattcagggtcctattatatataactatgctctggaagtaattgagattggccaaagaaagatgccagatagacaactcaagtgaagtctgaaattacaacaatggtgatatatataatatatttcatagggtttaaaaaatcacttggctaggtcattgctcatggttcagaagtgaggacttccctgcacgcacacatttatgggcttgaaccagactctcctttccccaagctggagatagttaagtacatttgtacacaaggctatctagtagacattgttggaaaacatgtattctttgaaaagtaggcaacaaaaacaaggtccctaaaagagctccaaaatctcaacatcacgaaaaaaaaaaaactgtcaataagtgaccagataagttaactggtggaaattttccctgatatttttctgttaagaaaaatctccaagtacgattgagtggactgcaaacatttagacttaacagttgtgtgcatgctggttgatggttaatactgtcaagcctgtgacagttttgaaaatataaacaagctggggaaattatcttcagtttcgttatctcaagacttccagtactacaaactccgtcaatgtaagctttgttaggaatttctgaacaaacctgttaacaacaaatggagatggtatttttcatctcgtgcctaaacaagcaaatatgttttttttttcttacggcttttgagtgttatagtagttatactacttcagaaattcactgaattacaatttaatccattggatactttctgcactaccattgtttctaacctctgcaggaccaaaaggagccaaatttaaacagattcttagtggttaacttgagaataatttacagaaaaatccaattgaaaggaaacagcttagggagctatatttttatgctagatttagcccaagtatgttcattcatacaggatatatcattatgattcaattagtagaaaactctaaaaaattaaaccataaagaggttgtagattaatttctgtaatgtaattgaagtgatgttagctcttgcctatcaattaggttgatttgatatttactatatagtccactaatctgtattcttttaataaataactaaattctgaatattagtcatgagcattagcatggaagtgtactactgggaaaaaaaaagaaacagaaaagtttctatgttaaagcaatacatggcttagcctgttttttgttgctataattgaataccggagactggatgatttgcaaagaaaagaaatttatttcttatacttctggaggctggaagtccaaggtcaaggggccgcatctgatgagggccttcttgctggtggggaccctctgcaaagtcctgaggtggtgccaggcatcacatgttgaggggggcaagaacattccagctctgtattccattcctcttcttataaatccacaagtcccattttggggctccaccttgatggccttatctaatcctaattacctactaaaagttttacctccaaatgccattaatatatgcatctgaagattaattgtctaatacatgaaatttgagggacacattaaaagcatagtaacttatgcacactgttaggttgcctaaaacatgaacccaggtgtgtgattttttttgctgccttcagagttgtgtcttttccagagtgtcatgcagttggaatcatacagcaggtagccttttcagattggcttctttaactgagcaatgtatatttgaggttcctccatgtcttttgatggcttgatagcccatttcttttcattgctgaatattattatatgatgtaccatgatttgcttatccagtcacctattgaagagtatcttggttgcttccaagtttgggcaattattctatgcacatttttgtgcatatttttgtatgtatatctgttttaaatgcatttgagtaactgccaaggagtgtaattttgtgattgtgtggtaagcctatgtttagcattgtaagaaactgctagactgtcttccaaaatggctgtatcattttgtattcccattagcaattaattagagttgttctacatccttgccaatgtttggtaccatcagcattttggattttagccattctaagagatgtgtagtggtatctcattgtggttttaatttgcaattcctaacgacatattatattgagtgtcttctgataagcttgcttgccatctatcttttttgatgaggtgtccattcaaatctttgcccaattttttttttttttttttgagacggagtctcactctgccatctagtggtgcgatctcggcccactgcaacctctgcctcccgggttcaagcgattctcctgcctcagcctccagagtcactgggtacagtcacccaccaccatgcccagctaatttttgtatttttagtagagacaggcgtttcaccatattggccaggctggtctcgaactcctgacctcatgatctgaccacctcggcctcccaaagtgctgggatcacaggcatgagccactgtgactggccttgcccaatttttaattggcttattttcttattgtatatcatgtacatgtaatattgattgtaacaatatatagtatataatatataataatgatatatgttattgttacatattttttcctcatggggttaatttttaagaattctttgtacattttacttttacaataaattagttggaatgcccctagcaccaagcatgtctagacactcactctaccctcactctactcagggacacttggtttggctcacaacacctacacctggagagcccaccttgggatcccacccaggtctaatgccatctcctccatggaaccttccttagttccctccaagcacccagcctctccctggtccaggatacccagcgttaatttcattgtctcatattatttttccccatctgccatgtttatagtaatatgagtagtcatttaacctcatttgtaagttattagggaatgaattggttgacctaatagtcatcattgcattaaagccacttatcaaagtaccttaaacataggaagtacacaggatatcttttgattcagactgaagacaatagataaacaccacaaggcaggccagaaattggagagagggtaggttagagtgatgttggagtgtcttgtagactgctcagatcttgaagaaagtttcttgttctcagtaactgttcccacctcatccctgacttttgatataaactatatcaaagatgtgtatgagccacttgatatggaatctgttagtaagatatatttttatacatattattgattttatgttattgttattgatatatcttaatttttgtatattaatatattgtatattaatatagtattgtttcttgacctttatatttataatatactcaatttatatatttcatacattaatgtattaatatacattattatatatcattcatatacatgaatattataactcaattatattaataatattttaatcggtttgcttggcaaacttcagcatattgcctaatctacataggcataaaagtcaaatgcaaatatatgttcctgccccaggtcactcttgagattattgcatttgccaagacactgtatctgcagacaaactttaatagaggccattaatttagatcaaattatatatttttggttggtgtgacttgtaaaattttaaaacagaaattatacattatacctttttaaaaaatcaaatcacttagaaggcttatagtgaagtttcccattctagtcctcttcctgcccatctggctctgtgaaggaaatacctgtaaccacttttttattttttctccaggtggttatatctttatctctaaataatttgcttgaatatctcttgaaaattttttaaccttaaaaattacatattagttttttgctataatctatgtatccaaagaattcaaatttttatttgggctgaaaagttgtttgctacctttctagccagcttgatatacctctctaatctctgttttatttaaattgagctaacaaaaggaaagggaaggacaaaattgattttaaacattactgcattaaaaactgaataattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaactgaataatttaaatgtatagtcatattaattgcagacaaactctaatctattttttacaaaaagctattttgttctttcttgatatgtttgctttgtgcaagtacagtttctggaaatgcactaagaagctgaaaatggtaaaatatctgtggtttccttaaagtagcatttttaacatagctaaaatgttcagtgtgataatttaacagctcttattttcttacagcattcgattccatagatataacaaagcagcgaaagcaatctgatgattgtaaaataaccctcagaaaaggaaaaataccaatggaaatttactagtctagttgattacaaataacccaaagtgactctactctctgctagcgtgctgagctgctttctttgttccttacagactggatgatgtcctggttggggcacctctctttatggaacgtgaatttgagagcaaccccagagaagtagggcaaatctacctgtatttgcaagtgagctctctcctcttcagagacccccagatcctcactggcaccgagacgtttgggagattcggtagtgctatggcacacttaggagacctgaaccaagatggatacaatggtaatttaaaccaaagcgtggaagtcatttatgtgtcgtcaccactgcataaaggagaccatgcctgttttaaagtattcagtatggtgtgtgtgggtgcagttattattactgatttttaataaactatcacaaatctcaaggcagctttacgtttatacattttgactaatataaatattacatggaaatttcccttctcacctttctgaaaatttttatttcaaatctcacaagattacaatgcaacacagagaaaaatctgtaacataatttgtttcaatcctaaatttagtataattgatctccttgtagaagacacattcggttatcagaaacatcagaaaaacctcattaagcaatgtcaaaaccatactacctcagagctcagtcttcagagctccaggtaatggtttgagggtgttactacattttgaaaacctctaaatgaattttaagagacattggaaggccacaggcactccaggttacaataaaaataagtacatttaggtttctgcaaacttcaaaataacatctcaaatgttcaactttaaacttctctacttataagtgctgtttacttgcagaaatatttcttattcagttttaagaattaaaactttaaagccaaagttaatacaaaaatcgtcattgctctgacgtccaagcaattttctcacatttgatgttggctatcctgtaatagctctcagtagaggcaggaattatttttaaaattgatgtttggatttggtgacttaaaggtaactaggaaaccttctatatgtcaagacaaataaatacatgttgatatattagcaagtatcctgacttctgatcagcctacatgggttatgtacaggttatactgaattttaattggcacgtaggcttcaccttagtttcaatatttgcaacaaagtagtgttaaactcgtaggttaggcttgtagttctttaggttagaatttatgaaacccctccaagtaccctctcctcagaaaaacacacaccttcacacaaaagtttgcatacattttcaggacctgaaaatgtatgcattttcttaaatgcacttcaggttctttagttaagaaccgagcatagtgaatttcttgattgaactcaaggaagtaacaggaacttgctgtaacaaagtagccttggaagtattcacatcagattagtattcattagtatatttggccaatgtttctgttctcttacacattctttgaaaaaaagttctcagcaacatatggttagtaaattttaaagtatcataaaacaaagtacatgtaaaaagcttatggttccagggaaattttttaaaagacaagcttacctttaagtgacttgctactctgtaaagctgctctattcctgatcactcaagtaaaataaatagtgctaaattatctatggagctgtcgtttaaaatcatattttcttctatttgtcttttctctcaaacctttaatagtatttttaaaagataaaagaagcattctaaatgacataaagggaggtcctagcttctctgagctttggtgtccttgagtatacaaagtaggtaaaatcatgtgaaattcactgagagtaaacaaggggatgggagtcaaggcagtgacttagagaaagttaagaaagtgtcgaaagtgttccttttcgcctgacacaagacaatatctttattttctacaaaaatctgagtttttagatcatctttttttttttttttttttttttttgagacagagtctgtcacccaggctagagtgcagtggcgcgatctcaactcactgctcaccacaacctccacctcccaggttcaagcaattctctgcctcagcctcccgagtagctgggattacaggcgcccgccactacgccaggctaattttttgtatttttagtagagatggggttttactgtgttagccaggatggtctcgatctcctgacctcatgatccgcccgcctcggcctcccaaagtgctgggattacaggtgtgagccaccgcgccaggccctggaggctcttaataaatatttgttggatggataaaaggcaacaaataatttgtcattgcagcagtactacagaattttcatggaaaacattataagccctttagagtttcgatactgctttttgagtatactaaactatttctgaaccattcttctgtacttaaaaaagaaacgtctctatggccaagcacagtggctcatgcctttaatcccaacagtgtgggaggctgaggtggggtgatcacttgaggccaggaattccagaccatcctgggcaacaaagcaaggacccattgctcaaaaaaaaaaaaaaattctatatatatatatatatatatatatatatatatatatatatatatatatatatatatattagcctgacatggtggtatgcacctgtagtcccagctcctagagaagttgaggcaggaggatcacttgagtccaggagtgtggggctgcggtgagccatgatcccaccactgcactccagcttgggtgacagagtaaggtcctgtctctaaaatgaacaaatgaagaattaaatacatatacacataaaacatgttttatgtctgtttttagacattgccatcggagtgccttttgcaggcaaggatcaaagaggcaaagtgctcatttataatgggaacaaagatggcttaaacaccaagccttcccaagttctgcaaggagtgtgggcctcacatgctgtcccttccggatttggctttactttaagaggagattcagacatagacaagaatgattacccaggtaaggttttctttcttttcccacgtgagagtctacgtcctgaaaaagagtccattttctgaaaaatgcatcatgcaaaggcagttttcttctacagatgaggctgaagcttaagcatgccacaggcttttttaatgtacgattccagagcgactttcatgagaacttgaagaaagacaaacacacgcttccttctcctgtcaagagacaatgatagaaaggcagaatggcttaacaatctgcattgtacataaaacttgtcaacttcacaacccaagttttcatttgaaactcctcaataccgcggcttgcactgacatagacagcttgcatcctttctggcgcaaattattttaacccttttgagctcatagctcctattatagcatgaacctcaacgtgtctgtcatgaagctcatgtttttaaagcataaatattttccagcttggcccatcatggtggctcatgcctgtaatctcatcagtatttaggaggccgaggtgggtggatcagttgaggtcaggagttcgagaccagcctggccaacatggtaaaaccccgtctctactaataatacaaaaattagctgggcatggtgatgcatgcctgtagtcccagttactctagaggctgaggcacaagaatcacctgaacccgggaggcggaggctgcactgagccaagatcgagccactgagctctaacctgggcgacagagtgagactgtctcaaaaaatatatgtatctcttccagccatattttgtggttttccaaagatagactgaacattttaaagtggagaaaaaaagaactggttcatgataggaaccataactattcttgatttacctaattcacattgaaggcacatggaaagccatgaggcacaggtaatttatgtattgtgcatgctatatgaagacattgatttgtcttaaaagattatttcactgtccaggttttttagcagagaacatcagacttcttggttttagggtttgattttcacttttatgtttaagatggtttcaataaatacttagaagtcattaatagttaaatgacagtttcaactacttataaaaaccttgtctctttccactagcccctcccctgattgggaattttccatatgtagagctattttttggtttggggcagcatccagtaagctgactgcctaaatatacatcattaatttcaggcctttggctttcttctctcctctgggattagacaaaaaggataccgcaacatattcttataaatttgccataaaccttttatgacactaatggagacgtcatagtgggctcaaagtggatttggtattatatcgtatactaatgcttcctacctgtggcaatttcaagaacatctagttaaatttattttcttaggttacattatgctaatcaatggtggttagttgttattactggggagaggtttgtatacataatatatccaaatttaaaataattcaaaaatctaggtcccttatgtaattcctaccccaaaaatgtcagggtgattaatgaaattcaactcctgggttgcattttaggtaaacaattagaaagttactgctatttattatggtagtcataggtctccttcccacccttagtaccaggaaaattgacagaaaggctgtgcctttgatgaggcaaaggaaatagaggatgtatccatcacatagccagtcctttgacttccttccaaggctaaacacgtcccaaatgagagccaggaaggacagaggcatgagtcaacttttctccccaggaatactcccttcagggagaaaaaatttaaaagcagcaggaagggaaaaggaagctaaagtctgtgcaatgttagtaattgattacctctttttttcttttcctttttttttctgagacggagtcttactctgccctcaggctggagtgcagtggcacgatctcagcccactgcaacttccacctcctgggttcaagcggtcctcctgcctcagcctcccaagtagctgggactacaggcgtgtgccaccacactcagctcatttttgtagttttagtagagatggggttttaccatgttggccaagatggtctcaatctcttgacctcgtgatctgcccacctcagcctcccaaagtggtgggattacaggtgtgagccaccacatcagccgattacctcttaattatgtctttttcttcccttaatcagaaatattcacttgaggccatgtgctagtcaacaactttgctgagtctgatgcaaattataataatcagacatgtcagtgctgtgcgtcttgtctctgaagtaaatgttctttactaaggcaggcccgtcaatgctgcttggttgaatttatccctcaagagtcttgaggctttcagagttcatccatgcatcttggtagacctgggttctggcgccaattctgtctctcaaataggaatatggatatcttgtgattcatgattctataacatttttccctgatcctcatcctctagcaaaaagaatgccattcaaagaagcctttttaacttcatagcaagatcccaggacctacagagaagaaactgccttagaggcaggcgactagattctcttattacagttgattgaaagctgcaggccaaattcaggaatcagacatgtaactttcttcatttttctagaaatgaattccatttagctttcaaagcctccatttccaccatggtagaaaatgatgatcttgcaatcacttctatgtttagatttagtcttatttaggtaagtatttattcagattcaagacccctcagccagccgtggtagcatgcacctgtagtcccagctacgcaggcagctgaggcaggagaactgcttgaacccaggaggcagaggttgcagtgagccgatatcgcgccactgcactccagcctgggcaacagggcgagactccatctcagaaaaaagactctttttctccaccctgtgtagctaccctcccaaggaatgaaatagaaaggggtttacctgttgtccagcgactgggaagagatatctggctcacacccatcatctgctattattggcttcagactaaagggtagctcagtcccttgtggcctttggggcattgctcaagcttctgtggctcgttccattgtctgtgtagtgacctctgctcaaaatttccctgtgtcctgggccctcttcgtcctctgttagcctctttcagtccccttttagcaaatgcttctgagccactgttaggactcagacacgcacaggctgggtattcaggtttctgtgattgccctcaggcttatctacctagattttccttagctgttgccagtttccacccaggcatctcattgctccagcccctgattgagctgcagtcttgtgatgttttgcctgggaagtaacaaaagccctctttcccctaaaggtagttggatggcatgctttctaaaccctatagttcagtcagtaaatgctacgttctaggcctccatgacttgttttgtgatttttccaaaccagtgctttttggaacttaaaaagataaacaatttctttcactctggggtcctgctttttcaaatcaaaagcactttgcctttcaaattatgaagtaaatacacctgagagcgataacatcagcataccccaaaatgaccctgggtggcacacacaccccaatgtggctgggaaatctgagctacggaatctgggagtggccagcccagagatccattccttgtctatgaggaagacctgacacccaggtcggtcccgtggaacacgggccgtagaggggattgaggccctttgtttttggattaaatgaaggttgccaggtggaggttgtcagtgggagagtactaagtgaagatgctttataaactgcatgccttttgcaagcggttgcagttctcttgcccagccctctacccccggactctctgccctgtacgtaggtcctcaatgaaacctcatgtctcacttgctggctgtttttcagcctcttgaacatgctgccatccccaatggagttgataagggtttgcacaacacagattactgtgccttctgagcttcacaatctattcaacaaattgacttcctccctctgaaatctatctcatcatcctttataaacaggggttcgcaaccttggttgcatattaaaatcacgtggaaagctttaaaaaatccgaatgttcaggccaccctccaaaccaattaaattagccactctgggctggagcacagactatagtgacatgtttaagtgaccctggtgattctggtgtgcagtactttgggaatgagtcctctagagcagtgtttccctgctgactgtgcaaacagatcacctgggtgtgtttatcaattgcagatcctgatgcagagatcaagcgggtggggtgagattcctcacttaaggtgcggcccttactgctggccttcacaccacaccatgcaatgagctgtagagtgctgagcttttccactgaggctctgagactcagtgtgcatgcatgttatctgtagggcttgttaataaagctgaatgcacagcaccccttcagatactgtgatgactgactctgagatggggatgagagatctgtgcctttacgcagcaccccactttgagcaaaaccaccctagattcttggcggctcacttccaggtctacaggagtcagatgcgccttttctcttttgccaagaactggtttgctaagccctagcatttcatttattctttacaagggtgtcaaacccaccagccgctgttctctccaacattgcctctgtgtggttcctgccatggtgatgcttgggcacatcccactcaggaaggggcaggggcaacttttttttttttttaagagataggaacttgtgctgtcacccaggctggagtgcagtggcacaaatcatagctcactgcagcctcaaactcctgggctctagcgatcctcttacctcagcctcctaagtggctgggaccacaggagcaggccaccatacctggctaattttttgattttttttgtagagacagggtctcactatgttgcccaggctggtttcaaactcctggcctcaagcgatcctcccgcctcaggctcccaagaagttgggattacagacatgagccactgtgcccaggatccttttaaaatttactcacagacatacaggcgttcagctgccctgtttcaaattctccattctaagtagatcagaaacaaaattccaaaatttgtcactttacctggttacctgcagaatttatgagaaaacaaatgcaaaaacaaacatttaaaatgctaaatggaaacaagtcaaactacttggcatgattagggaatggaacacccctgagaagccacacttatcaacagcaatgctttctgatggggttatgatggggttggttttcccattcttgagataaacgctttctcctcatttcaggtgacaaaatgcttagcagctctgtctaaaagagtgggcagtgttggcttcccctggttttcactgtctgatgtaaacccttttctgtgcagcctattaagaaatctacctttaataatggcagggcatacacattgccccaatcatagatagtagcaaacactcttacgtattcttaacacaacctggctgcctttcacagacagaggagggctgattgtgatgttttatgtgtactttttgtgcattatagctgtttcatcttccaaactgactcaaaataaattaacacggcacctcaaataaccgaaaacacagacatataagaggtggtttggtttatatttattcattgtcaaacgatctgttctgcatgctacagatgttttgtatataatcaggactagttttttagtctttggaggaaggaatgttagcaaagtgcaggcatagagtctgttatgttggtaatgttttttcaattatactaattattagtgctaataattaagagcccaaagcatgccagccactgcatagaaggtaaatacagtgcttattgtagaatattatcgtggaatctctctcattcacagatatatatactcaaacatctatgtatgtattttttatatgtactatatatgtatgtacacagagtttatagggtaggattggatgacacctcacttctttttggaaaacatcaagccaatttaaaaaaaaaaaaacttttaaagttagccgatgggcacggtagctcatgcctgtaatcccaatactttggcaggccagggcaggagtttgaaaccaacctaggaaatgtgcaaacctctttctctactaaaaatacaaaaaattggccaggcatgctgcagtatgcctgcagttccagctacttgggagtctgaagtgggagaatcatctgagcctgggaagtctaggctatagtgagctaagatctcaccactgcactccagcctggacaacaggagtgagaccctgtctcaaaaacaaaaaaaaaaaaaaaaaatttaaagagtctgtgagaacaggggaaggaaaatcggattacctgagttcagattcccattgaatactattaatgtaacaattgaacagtgatttactttcagcttttatttctttatctggtatgatggggctgataatacctacttcactgggttgtgtgtgcctgcactttctagggcgggagaggatttttacaaaatgctgtcaaatggctcagaatagaaaaggaaaccaatttgctgatcatgaacagaatatgagctacttcacctgacagtcatgtggagccacataagattttgaaaaactgcattctaggatgctggagagggacagcctctgtttaaaatctgatttagagacagagtctcactctatcgcccaggttggagtgcagcgtcacaatctcggatcactgcaaactccgccgcccaggttcaagggattctcctgcctcagactcccaagtaactgggattatgggcgtgtgccaccacgcccagctaatttttgtatttttcatagagatggggtttcaccatgttggccaggctggtctcgaactgctgacctcaagtgatccacccgccttgaccttccaaagtgctggtattacaggtgtgagccaccgtggccgacctctttcatttttcactattgtgccttactggttaccagaaaaggaacacgctgctccctcgctgccccttagccatttaaaaatatttaaattcatttaaatttggcctgaagtatggtaatgacagtggaaattgaaaggaaggaactaacacaacagtgtaaatgaaaaatagacaaggcttggtaacaactagcagtgatggaagggagaggaggtggcaggaggtaaggaagaggtgggtgtaaaagatgactcagatttgaatgcagtgtacccaagaaaaggatagtctcatggacagattgggggattttgttatataatatacagatttgattgcagaaataatgtgtggaataattttcctaacatccacctcaaccacccaatacgtttttaggctttttacaacaaatattgtcactggcacacacactacatagagtcataagtactttcatttctagcatcaaaattcattttctgattcaaaatgtagatgtgttcaggtctgtatgttggggttcattgggaaagtaggattgaccagaggagtgtcttgcatacattaattgagtgaaagcattttagaggagaaacagccgtgatagtcaggaatcttgaaatccagtgatctcctctaatcccattaaacgtgattgtataacaataccatctgttaaatgcatagctcaggcattggaaggtggaggaggggcggtacagattttgttgaggggcagaaatcctacaggcaagaaaaactggaggaaaacatgggcagaaggccaagactatcattgtctcatccgggcccctactatataattatatcatgaagccatttcagacaattacactcaatgaaataaaataacccattatcttttcaatgagtgctctgtgtgtgtgtgtgtgtgtgtgtgtgtgtgtgtgtgtgtagtataagcaaacaagtaacacagaacctgcgcatggaaggaggctttatccaaagggaatactgcatttcaattaaactttaagctccttgaaattgttaatttgaagttcagttgaactaggttcaaacattatagtcaaagtttatttttacttctcaaactgctactcaagttttgtgtgaaaagccaagcattatgtttttattgactaagatattcatagtttcatgataaacacattagaaattagaatattaaattttgggtaaaaatatctcatgcatgtagatcaaattgaagtaattcaactgggagagctcttggacttcaattgaggagtgttgtcaagtagaaatgaaaatgagtggaaagtgaaaaggcctgagttctagaaccagttctcccacgtgtgattttagtaattccacctctctgggtcttgccttccttatcaagaagtgacaaaggtgcatggattactcctcccagggtctttttaattctacacttctctgatactatcatcccagatctagatttcctgcctttacacagtgctctgtaatattgggtagattattaaggatctatctttaaaaagatttagtgaaggccgggcgcagtggcttatgcctataatcccagcacttttggaggttgaggcgggcagatcatgaagtcaagagatcaagaccatcctggccaacatggtgaaaccctgtctctactaaaaatacaaaaattagctgggcatggtagcacgtgcctgtagtcccagctactcaggagactgaggcaggagaatctcttgaacctgggaagcggaggttacagtgaaccgagattgcaccactgcagtccagcctggtgacagagcaaaactccatctccaaaaaaaaaaaaaaaaaaaaagaaagaaagaaagaaaaaatatttagtgaaattattttttctcaatgttttcttggaaatacttttggactcacagaaaagttgcaaaaaaatagtagacccttataaactcttcccccagctccccctcatgataaacatcttatgtaaacatagtacaatgagctattaatgaatcaatggacctattcgaaattctatcgaatttcaccatttgtccctctacagttcttatttctagtcccatgattcaatctgggatcccatgttgcatttagttatatttccttactctcttccaatctgtgactgatgatgctgacggtagaatatgtgctgattatatgatattcaagagattgttatccatatacccagcaagtatgtgttgagtgacttccatgtgcctggcactatgctagatgttgaggatacagcactgaattaaacaaagatcctgctctcacgggcccgaattaaatcaaattctagctctaacactggctggatgtgtaaccttacccagttaatcaactttctggagtctcagttttctcagtggtaaaacatgtataataatacctaataatagctttttcctttaaagttgggttttggaggttcagctagataatatgtataaatcagttaatggtgtgaatagcatctagtagcagccactaaatattagttataaatgacatattgttactatatgggcataacgcatgcctttaaggagcaatgtaattgtggagataaaacatccaacaatgaactgtaatataagcagcagatgagaagagctttaagagggtacaaaataatgaaacagttaaaaagagagagtgtttcttgctaaggtgataagagaaagtttcctaagggagataagtaggatcctgagataggtatgactgtgagtggttgtagggagaaagcatctcagaaggggaacacagcatgagcaaagaccctgagattacatgtgtcaagtgtgttcttgccacagtcataaaaagcaagacttcgcagaacagggagcattgaatcagggaacagaaggactagatgagaaaactgccgaaggccatatgtattcaacgtcttttggtcatcatctgacccagataatttcctacttttgacaaccctttgtattatcaagggatacaacattgtgaattaatgatttgacttagtgatatatgagtgagggggggaaaagggatccacagatttctaggactatgtaatataggtagaatttaaaaggaatttggtggctgggcatggtggctcgtgcctgtaatctcagcactttggaaggctgaggtgggcagatcacctgagatcaggagctcaagacccctctggccaacatggtaaaaccctgtctctactaaaaatacaaaaattagccaggtgtggaggtgcgcacctgtcatcccagctacttgggaacttgcttgaacctgagaggcggaggttgcagtgagctgagattgtgtgctgctgcgctccagcctgggtgacagagcaagaattcatctcaaaaaaataaataaaaataaaaggaatttggcataaaataattaatgttgactgtttcagttttatgtaatgaaaatgttgcctagtttgtctttgttagtatgtactgcagaattttttaaccataccttctttatttttttgatcatgctaaaaaggaaattctatatataagttaaaggaaatgcttcctagttttttcaaaaaggcaattttggaagtgaattggtccaaaatgatggaagcatacatggagagaggtaaaaatgaaaggtggactggggacagttaacaaagagccttgaatagcatgtttagcaattagttattaggaaagtaatggaaaaagatatatgctctgtattccaaagtggtgctttaaggacctcattccttagcaatgagcagaatgagtaataatgaaaaagaaacatgaaatcaaaagtcattaaagtatcccaggggaggataatgagatgaaccacgtgatgtagcagcaaggccagggcagctggaggtgtctggagattaaaagcctaaagaatgaggaccagcagtgactgtccagcctcccatccttcataagacagcctgggagctgctgtgcacacgtctcaagagatcccactgtctatatatcgttaaccttgaaataggcctttatattcagaggtgtgttaaaaattggttaacaaccagctcctcagggagaaaaaaaaaagcccagatttgtaccacttaccaatttccatggtataaatatcctcaccatgattgatttcaagctgtagtgaccttggtgtgataagagtgctacaattgctatctgtatcactgaatgaacctgaaataccgacctgcttctgcccagtcacttacaaatacactaatctcctgtttgtgggatgtctttccaagagggaattactattttcagaaattcacagatccaggttgagaatgactgttgtctacactcacagctgcatttatgaaaagaccaaaacaaagattagctatagtcattttcaagtccgataacataatatctgacttttttccagctttagattaagatatgaaaatgtaggaactgtcatctctctcaaacaaatatttctattttgcttagtgtgttgtgaaaacctctgagtacctccatctgccttatttctgactcccctttgaagaggcaatcctattgaaaaagtggaccttatcgacacagctatgtcaatgaccttaaatgtgaagccaggactccctcacacacctgaactccatccctccccatgcttgaatcaggttctcagataaagcctttcacaagtaataaatccttattatttcacaaataatatagccttcagaatccagattctgtcccaaagcaggtttaaatcatatcccactcataggtagtaaatacagcaaatttccctcgccagatacaagagatctaactatatggctattagattttctatgccacaaatcatttgtcagtttaagtttgaactaacttccttccaaataatcagagactgggttctttctgaaacccagtgtatatgataggatattatttatacttgatcttgcttataaagatacagttaatagaaatttgctgcttagccatggctttttttggggggggtggggctagaagtccaatgtgctatcaattgtgccatagagtcctcttggccatggcttttttttttttttcttaatatactttaagttctgggatacatgtgcagaacatgcaggtttattacataggcatgcccgtgccatggtgatttgctgcacccatcaacccgtcatctacattaagtatttctcctaatgctatcccttccctagcctcccacccctcaacaggacccggtatgtgatgttcctgtctctgtgtccatgtgttctcattgttcaactcccacttttgagtgagaacatgtggtgtttggttttctgttcctgtgttagtttgctaggaatgatgacttccagcttcatccatgtccccgcaaaggacatgaactcatccttttttatggctgcatggtattccatggtgtatatgcgtcacattttctttatccagtctatcattgataggcttttgggttggttccaagtctttgctattgtgaatagtgctgcaataaacatatgtgtgcatgtgtctttatagtagaatgatttataatcctttgggtatgtacccagtaaaaggattgctggctcaaatggtatttctggttctagatccttgaggaatcgccacactgtcttccacaatggttgaactaatttacactcccaccaacagtgtaaaagcattcctatttctccacatcctctccagcataatatccagaatctataaggaacttaaataaatttacaaggaaaaaacaaacaaccccatcaaaaagtgcatgaaggatatgaacagacacttctcaaaagaagacatttatgcagccaacaaacgtatgaaaaaaagctcagcatcacagatcattagagaaatgccattcaataccataatgagataccatctgttgccagttagaatggtgatcattaaaaagtcaggctttttttaaaaaataggatataaggaatggagtatgaattagttggagtcaatttctcctgtgtttagaacctcatattatttcttccctccctctgcatgttttttaatatgtcactttgaatttactaatatgtaaatcggaagccatattttcaggtcattcacctgatgcatcccttctgcctcagagtctctctgtgccctggccattttcccaggagttcatttcccacttagacactcagtcaaatgtcacttcctcaggaagccttccctgaactgttgtccttcccctgaaaacaatgatctcagatggaaattacacatgtgtgcaattctttgataaatgtcctttctgctccactaaactggacactgtattagttgagactgggagtggatttggcgttactcactgcgaaatcctaatgcccaaggcagcggctggcacaaaaggcaacttgtcgatatttgttaagtgaataattgaatgaatgaatatgaataaatgaataaataaaccagcatccttccagctgcacaccttgtatataaattgttgctcatatctttaacttgccactgtgtttcaactctacttaaaatccagtcaactattttatgtttgtgcagaatgagaatggaaatataagtagagatgatgatgatgccctttaaaataaatgttggcatctgtctcctgttactcaaagtagcagactgattcttggctagcgtttaacccttgaccctagttctgccttcaccagtgtcaatcgagaaaaatgacaagtctcaattattttaagaggtttatttgccaaacttaaggatgcattcctggagacaggtctgtgcctttctccaaacttgtttttttgtttatttgttttgttttttattgttgtttgtttaagtcttgctctgtcaccaagactggggtgcagtggcacaatcttggctcactgcaacctctgcttcccgggttcaagagattctctcttcctcagcctcccaagtagctgggattataggtgcatgccagcacacccaactaatttttatatttttagtagagatggggttttgccatgttggccaggttgatctcaaactcctgacctcaagtgatccacctgccttggcctcccatagtgctgggattccaggcatgagccaccatgcccagcctctgaagacaattttaagggctccaaatttaaaggggaaagggcagaatattgagaaatacacaattttcatttaagaggagggtagggaaaaataatcatgcctgcctttgtctggctcagtgaatctgcatttttcttttacataagatgacatagacaagtggggcagaggaaaaatgcagggagcctgcctttcatataagataacatagatgaaatggggcagagggggtgacatagatgaaatgggcagtgggggtgactgcacttataaagatatgctatcaatttacattgccgtggtgaaatattaacagaaaccccctagagtgaagatcttgcagctcactaggaatttccttgtgggcaaaatatgggggaggcatgtaacttttcatctcgttcaggaaccaaaaacggagaggcaggtttgtgtgacccagttcctagctagacttctccctttggcttaatgagtttggggtcccaagatttaatttcctttctcactgggccttcagatgccagctgctcttggctgtgagaccaggagtacgagtaggcagtgtgatggaaaaagcgccgtgagtaggggtacctaaattctcttttgttaccagctctgcagcctgggccgcacttgcagctccttaaccttagcctatccagccacaaaagaaaggtgatcagaccaatgcccaccactcaggattgttgtagagacaatttgcatgctgtaaagtactcgcacagttaattgttcctttttaatttttaaattttttgatacataatatttgtagttatggggtacatgagatattttgatacacacaacaaatgtgtcatgagcaagtcaaggtattaaggatatccatcaccttgagcacatcaattgttcttatttttaaacaccactggccaaacggaggtagtgttactggaaaggggtcctgatccagaccccaagagagggttcttggatcttatgcaagaagtagaggtgaatctggccgggcgcggtggctcacacctgtaatcccagcactttgggaggccaaggcgagcagatcatgaggtcaggagatcaagaccatcctggctgacgaggtgaaaccctgtctctactaaaaatataaaaaattagccaggcgtggtggtgggcgcctgtagtcccagctactcgggaggctgaggcaggagaatggcgtgaacccaggaggcggagcttgcagtgagcagagatcggccactgcattccagcctgctagacagagcgagactccatctcaaaaaaaaaaaaaaaaaaaaaaaaaaaccaaaataaattagaggtgaatccataaagtgaaaggaagtttattaagaaagtaagataataaagaatggctgccataggcagagcggcagcatatgggccgctcagctgcttatacttactgttaacttcttgattatatgctaaacaaggggtggattattcgtaagttttctgcgaaaggagtgggtaattccgagaactgagggttcctcccgtttgtagaccatatagggtaattttcttacgttgtcatggcatttgcaaactgtcatagggctggtgagagtgtcttttagtatgctaatgcattcattataattagcatataatgagcagtgagcaggaccagaggtcactcccgtcaccatctcggttttggtggttttgaccgacttctttactgcatcctgttttatcagcaaggtctttgtgacctgtatcttgtgctgacctcccatctcatcctgtgactcagaatgactaacctgggaatgcagcccagtggatctcagccttattttacccagcccctattcaagatggagttgctctggttcaaatgcctctgacagtaggaggcataaaaacaacctccaaggctgagggtccaggttctgcaccccagacccaggcctgtgccatcagatgttgacttggggaatctctgtctcaaacctcttctgggatgacagatgggaggttttcaaaataactaatacagcaacaaaggcctctttcatctcttttgtccttcctgtttgcaagcattgttcatgtgatgctcttctttctatatgccaacccttttagattttcttactgacgttttcctgcaattacattaatagctggttacctgaaaactatcaaccctaagagaagttcacgagatagccagcgtaagccagaaagctggcggtccaaccagaccacagactaaagagtgaagcaggtgaagcttgtctgggggatgctcagcccctctcatcctgttacctctcttttctgtgcctgagggctgctgcatactaattgcagaaacttacactctttcctcttctcaaacatgtgaaagagaaggatcttatcagaatgtgagtgatccagtgaaagtaggtcccacccagggacttcaattcagtggatcctggcctgtgtttgtaatatgacccctcagtgagttgattgatagactctaagtagctggaaggcaggggagtgtctgtttttaaagccccctgctgaatcctgggcagttagggtgggacctggctcatgctggaagttcaataatgagttcttagatgagggtgtccagtatagggaaccacctgtgtacctgttcttcccttcctctcccatctcccttgcaactccgtcaatcgcaaggctgccatcacacatcacagactggagggctcaaacagggatacatttcctaccagttctctaggctgcaagtccaagatcaaggcgtcagcagggttggtttcctctaagcctctctctttggcttgtagatggtcatcttctccctacatcttcatgttgacttctctctgtgcatatgtctgtgtcttagcttcctcttcttataaggacactggtcctattggattagggcccacccagatgatctcattttaaactaattacctctttaaagaccctactgaagcagtgtttttgtctggggtaaatacctgaggttcattgtttcacgacaagggaatcgagggtgcagatatacacaagaactgggtttaggagcagcgatttgattggcaaaagaaagagaaaggaggccgggtgcagtggctcatgtctgtaatcccagcactttgggaggccaaggtgggaggattacgagatcaggagttcgagacaagcctggccaaaatggtgaaaccctgtgtctactgaaaacacaaaaattagccaggcatggtggtgagtgcctataatcccagctgctcaggaggctaaggcaggagaattgcttgaacccgggaggagaggttgcagtgagccattgcactccagcctgggcaatagagtgagactgtctccaaaaaagagaaagaaaagaaaagaaaagaaagaacatctctctctccagagtgcactggattttatagacaggtttgaggaggcagtgtctgatttacatagggcccaaagattggttggaccaggtgtgacatttatacaacatgcaaggaagctggctgccccaccctaatcttatcatgcaaatggagtttttgcctggcaggtgccatgttgcctgtttcttcctgtatacctggctggcaaagatggagccaccattttgaacatggctagtcccaggtagccttttcttattggcacagatgccagcattcacccatgcaatcttccagcttgcttgtctatgtctgcagctcgattttataggctgctctttgctagaaaagaaaatgatttgggggctgcttttcattaaaaggaaaaccttactgaggactcccgtaccctcatatctgcctaaataatttcttcttaactcctatatcactatctcctaatatagtcacattctgaggtgcaggctaatacagtcacattctgaggtgctggcagttaggacttcaacataggacttttttggggggacacaattctgcctaaaacacttagcgaaatcatcaagtcccattaggtttttatcaataggagtttatctgtcaggctaggtgtcagggaagcatctttgtgagctatcacgctcttctggagactgtgaaacactttccaataggcagctacatacaagtgacactggtactgtagaaataaaccttcctccagggctttcagcaattgcacagacggcacacatgtgattcagtgtggcccatgaagaggataaagttaaatgcctttgatacggtgacacgaaatacaacaagtttaggatcaaacagttgaaggtggaaggatcattcttgtagccacaggatgctaataatatacagaaaactattttcataaggcagactcatcatttgatattctgctgttattttttgtgggattgttttaaaaggaaaacaatcccccagtaaattagaatgttgcaacctaataccatgttccaactcataaatgtttttcttcagagttcatttggaagcatttcagacagattgttaggattattactttctgggataaaatcatgctttttttttttcaaacatttcttcctcaactcataaccttcctctcagtaatattttgcatgttgcaataaaaaagcaaggcagacaggcaacttctatttttagattaacacgtttgccaaagtcaaggagacttatctaaatgctggattcccacagacatgagctgtgtttgcaatgccagacacttaagccaatttcatagcccactcacaagtggacattgccagatgtatccgccatctgtaaccccaccattggacacattatctcgaattctcttatttctcttaatatcatcattgtatgaaagtgagccaaccttgggttggtttatctaaacaactatacttgatggccttagttcgtctttaaaatatttgggtgctgtgggaagaggattggcaggatgggacctgggcagtgatgggcagttcctggaggagattctgtgagctgtgggcagttgtattgccaagacaggagtcaggcgtctgtagagctgagttatgaaggcgaatgggaagaagtccagtctggtgaagccagggagaaagccagaaactggctgtctctcagtggaggcacaaggagtccctaaatctgcaggaacacagctgagtccaaaagcaaagcagagtcctggattgtacatcaaagtgcccagaatgcagtcatcagactccaacaaatgctactgagctcttgcccttctcatctagagaaacttaaagaccaccagagattcagcaatgaagattgacttgttcaatgtcatttagaagccagtagcaaagtgaactggagttgagaattgctgatttttcagctgccacttggtaattttgcacctgacatacaacaccgtgtttcaaagaagtcttcaaaggttttagagagattcaaagagagacaacgggcaagtcaaaattggcctgttgatgcacaaactgctgtacaccgatgttgacagtgactttgcaaaaactggaaaaacctcagggttccctaagccagggatggatgaataaactgtgggccatctacacagtggaatactactcagcagtaaaaaaatgaactcctggaacacacaacattgtggatgaatctcaaatgcaccgagctgagtgcaagaagctagacccaaaaggctgtatggctccatttatatgacgttctggaaaatagattagtggagtccaggggttaggagacaggtcaggcttggctacaaaacagcatgggtgacatttgggcatgatgggactgttctctgtcttgttgtggaagtggttacaggtctgggtgcatttatcaaagctcttagctctgcttactaaaaaggatgaaatttatcataataaaatgtatctttatttatttatttttatatctatttatttattgagatggagtctcactctgccaccctggctggagtgcagtgctgcagtctcggctcactgcaacctccatctcctgggttcaagcgattcccctgcctcagcctcctgagtagctgggattaaaggcaactgccaccacaccaggctaatttttgtattttttgtagagatggggttttgcactgttggtcaggcaggtcttgaactcctgacctcaagtgatccacccacctcagcctttcaaagtgctgggattacaggcgtgagctactatgcctggccatatctttaattttttttaaaggcttaaggagagaataaaaacagcatgtagttgtgcacctagaaggcagtgtaaaaaggagcccagtgtgggttcaggagccagactgcctgggtttaaactttggtcttgtgactttactgtattcgggctctgtacctcatttttctcattctaagatggggataataaaagtatctttctcataggattgttgtagcacttaaaggaggcaattatatttaaaatgtttagaatattagcttttctttgatctatctttacacaactgtccaacatatcctcaggataaattcctagaagtagaaactaggtcagcggtacacatagtcatacatatcaacaaactgccttccatgaaaataatgctaatttatactccctcaaacagcctataagcatacctctgctctctatccaacaccacctagtactaatcttttccaattcacaaggttaaaaaatgatatatctatgttcccttcatttggatttctttgatgactagtaaggttgaagtcttttcatatatttattagtcacagatatttatttttatgtgaaatggctgtttgtaatctttttaagaatgtttatagttttaatactaatttgtatgattaggcataataatcaatgttaacttttttttttaccaagtgccaaacattcctctaaacattgaaaaatattaacatttaatcaggcatatacattataaacatttcaccctgttgcttttgtttctctttcagccttgctcatgtggttttttttttgttttgttttgttttgttttgttttgtttgctataaaagtcgtctagattttgaaattcctttgtgatttctacatttttggtcatgtttaaggaggtcttcccttttgattaatcataatgtttttatacaactataagatagacactaccatgtttcacatttgtttggaaattcctggtggccattctcattgtctggaattattctaaaatagtaaatgttttttaattccaaaaaaaagaagatgtccaatggcatttttgggaacagatataaacatcagtgtatctgtcaaggagatgagagtgagaagtgggaagaaggaagcaggaggaaggtgacttagcttaggaagtataggtgcttgggtggccacagagactgctcccctgaaatgattctgggtgattcttttttgttttttgttttgttttgttttgtttgagatggagtcttgctctgtcgcccaggctgcaatacagtggcatgatctcgctgactgcaacctccacctcccgggttcaagtgattctcctgcctccacctcccaagtacctgggattacaggcatgcaccatcatgcctggctaatttctgtattttcagtagagacgggttttcaccacattggccaggctggtctcgaactcctgacctcaggggatctgtctgccttggcctcccaaattgctgggattacaggcatgagccaccgtgcccagctgttgtttttttaatggggtctcactatgtttcacaggctggagtgcagtggcaccatcatagctcactgcaatctcaaactcctgggctcaagcgagcctcctacttcagcctctgaagtagctgggactacaggttttataccaccatgcctgactgattctttaatctgatactgtcagctcttcctcatcttcccctttggcctgaccgttccctaggaggggttcactctccctcccttcactgtttcctgcccacctaatccaaacctcagatccacactcaaaacaaagctgatgttttcaaatagaacttcttccaacactaaaatttctttcccaaattagtgaaatcagactctgcaaaccaagcaccactttaaaggtttggcttttcttcctcatttaaaaataacgatttgcaagaaataaaatacaaaacataggtgtaatgcatctcctatgacctcacatttttagggtttttttttcttgccaactgatcctgcattcatgccaatgtcccctttttgtttccttaaaagtactcagttgttccatcaaaagccaaaaagaaaataaactatgtttctcaggcaacgtgaggcaatagcaaaggcctccagcagtttgggaacagtttttgattgaaaggaaagacccaattttaattgtcagttatttcctccaggaaaaaaaaaaaaagccagcttaagtgtctatgtatagagaaaggcaaagttttttatttgtttgttttcaatttgcccttaaggcatttatagaaaggaagtaaacatagataatggtatcagacccgttatctcaaagtaagggagaaaaaaatgttccaagtgttataaattcaaatatcagccctgaaactactttgtctctagattaacatttaaattcctaagcacagaattatgcaatatcttaaaatattatttctgagtattatttaaatatcatttcacatgcacacataaatatacacactccagcataaatataaatgtatgtgtatataaatagaacagatatataacagatacgctgcatacacaaacttctatacttatgtgtgtatagatggaagcagcgtagtactttccaaagccaaccacatattttgaaaagagaaattcattcaaaacacaaaccagcaaatcagttctcctcccctggagagatctgacaattttaaggtcccgagcataagtacttctggctctttctagcaggcatattcccaaggtagtgtctctaaaggcaaacatacttttgtggtaggtaactgttttctttgcctctgaataaccgtgaccacattctcatgaagaaaattgtggcctgtgttgccagttattttatttttccagagtagaaaaaattcccacccgaaggcacagaaattaaagttcctaaaggaaaagcccatgtctcattaccgttgggagggtgtccctcaaattctcacgtataatgacaatctagttgtgatggagactttatattactttctagaatctggaacgtgtgtgtgtgtgtgtgtgtgtgtgtatctcaacaccttcaagtatacatgcaaaactccagcagaatttagctgcagttgacattagtcggttttaattgtttcattttcttcatctctagtatctttagtttattattacattattacttatgctccctatttaatcaggcatttatgaagtctctgttctgcatctggcactgtgcctggtaacatgcatgcaaaggttatttctttcttcatttatttcaacccataccattccatgaatatttggggatgtgcaaacgtaaagattcctgccctggaagggcttacagtcttattttctttgccatttccagagaatcaattcttaaaattcgcctgttatttataaaatgtctaatcttattaaataaatatttcaccttatttggggccaagaacaaagcacataattcatcgtgaatcagttttcataacagagctctcctatctggtgtcatgtcaacagatatggattcaggccagggccacctgtgttacacttgtctaaatattggagtttgtaattacacaggaagaacagagctcatgtttcttcaaatcggtagctctttttttctctgatttagaaaaaaaaagtaccaatctgttagaagagacaatgtaacagaaagaatacatgtaaacatagttgaaaaattgaaattctgatagaatttatcattataattttaaaaactggtaaacttagaaacttcggcatctggcttcagagatttaaacccttacaaaagaatgttttattccatgagtcctaggtggccaaggtgtagccctttgcttaatgtgttctttaatgccatgaatatggagctctttagatgacgtctgttcgacttatttgaacatcagcatgcacatgtttttaaatatggagctctggagtcaagttccaagtctaataactgaatctgattctgtgtccataaaacctaagacatctgacagtggttttgacctggagaactttcagatcatttttttttaaattttaacaagtattattgtgtcttaggttgggttgtcccagagcaggcattaagacaaagatgagaaaacaagcagtgcatttaagaaatcctgagaaatactggtaaaggtagagaagagagacatggaaaagaagaatgcaataaagatcatcatcaagccagttgccactacgggcaatcagggccccacctggctgaggaaagcaaagtcaaagaacaaacctcagctatcccacttgactgataaggaagctgggccactcactttctaattcctacctgtaactgactaaaagccattctcagggacactaagccctcaaggggagaatcatctgcagtctctctctgttcacatgtacagtgtatcagtcagggttctctagagggacagaactaataggattgctgaacatataaaggggaatttattaaggagtattgactcacacgatgacaaggtgaggtcccacaataggctgtctgcaagctgaggagctaggaagccagtccgagtcccaaagctgaagaacttggagtctgatgttcgagggcaggaagcatccagcatgggagaaagatggagtccaaaagactgaaccaatctagtcttttgtcgttcctctgcctgcttttattttggccgtgctgacaggtgatcagatggtgcccaccagattcagggtgggtcggcctttcccagtccactgacccaaatgttaatctcctttggcaacaccctcacagacacacccatgaacaatactttgcatccttcagtctgatcaagttgacactcaacatcacatgtgcaaaaggtgagtgccaaagggaatatggctgtaaatcatttttctgtacaaattctattacaccaatttaattcctgacttagttttccatatggagtggccaaataggacctccctccacctttgttttttgtttttctattttcattcgcgttgtgctagaattaaccaattatagtttcaactgttgtaagtcttcttctgtggcccttatttctaccaagtccagttttctttttctttttttaaatttattttagattcaggggatacgtgtgtatgtttgtcacatgagtatattgcataaaggggtttaggcttctagcatactcatcactcagatattgaacactggactccgtgagtaattcttcaacctttatctccctccctccttccccaattttggagtccccagtggctatcattaccatctttacatctatgtgtactcattgttttagctcccacttataagtgagaacatgcaatatttgattttctgtttctgagttcacttaggataatggcatctagttccatccatgttgctgcaaaagacatgatttcattcatttttatggctacataatattccatggtgtttatatacgacatgttctttatccaatccactgttgatggacacttaggttggttccatggaggtccagttttcttacatctaaattttactctgcagatttagccattgtcatttttatttgtgtttgattgcttctactagggacagccactgtaaatgagattaagaaaagcccgccaggtgcagtggctcatgcctgtaatcccagcactttgggaggccgaggcgggtggatcatgaggtcaggagatcgacaccatcctggttaacacagtgaaaccccgtctctaccaaaaaatacaaaaaatcagccaggcgttgtggcaggtgcctgtagtcccagctacttgggaggctgaggcaggagaatcacttgaaccctgaagatggaggtttcagtgagccgagattgcaccacggcactccagcctaggcgatggagcgagactctgtcaaaaaagaaaaaaaaaaaacagacagtttgacctctatgttagccaatcacctaaataattgtgaccattcccccttacctagtccaggattgctccactgcagtcaaccagttccaccacttacctacttgtgtgaatgttaggaaatttacagtttagccttcttaagtctcaattgactcatttgcaaaattgtgctaataataaagacctcctaccttcttgttaggaatcattcaaaggaaatcctttaaaaggactcctggcatatagtgctgttccatgtgctatttattaggattgctgttgtcatttcagatcattataatatgttagttattttatatactactgattgctttgccaaaagtatactcaccacccatactatttgtaaagagcaaacggttgtgtcaaaatgacaatcagaacgttccacttctgggttaatacccttcctcatagggtattcactggtgagagtgataacacgaaatgtgtaatgagcctggtacctagcagacactaagcagctgactttccccttttccttccctgggtgtatatgccttgaacctgaaggataggaaaagtgatgcgatgatgagtttctagaaattgaccttcctaagcacagaaggctttgagatccactgatggacgttttattaagttggttatagtgaagctccaacatcctttccaaaatgccttaagaaaggtgtgatttctcttctaattttgtggctctcgtaccatcagcatgtaggggtattctatgtgctacttacgattttgaacttagtaaattgtttctatacgattcacgcatgtgttctgtgtttttgtctttttaagatttgattgtgggtgcatttggaacaggaaaagtcgctgtttacaggtatgtggttggtagtattcaaatgtttttctcattgtttcaaatacattttcttgttagttctgccttaaagagagcattccaacgatttattctggggaatatttagatgctctttttaaagtctagaggtattttttgctctcactctttctttcctttgcatttttactctcatactgcatgaccaaacttccagattttatgaacataacgttaaataagatatgaaatgaagcagatcttataaaatgacccactttttagacgttactgaatttgatttattctctttgctttggaaatgcattgaaatgttcacttgtaaagaagcggtgcagggtagaagaatgttactatttatcctggcttctataatcaaactggacactaagttagggaatagaacattccaagagttggtagcctccaaaggcaagtattgaaaacagttcaaatacaacagctatggattccaagcctggacattccatacactgacttatttgtaatcttgggcaagttcttatcactttcagagtttcagatttctgatctgtaaaagaaggataaaaacaacatttataacgttacctttgttcaaagcattcagtgagaatatgcgtgtggtgtacacagaatagtaactgggagagaggtggtgctcaactttagcttcttttaaaaaaaaaaagttttatggcaggacacggtgcctcatgcctataatcccagcactttggggggccgaggtgggcggatcacttgaggtcaggcatttgagactggcctagtcaacatagcaaaaccccatctctacttaaaatacaaaaattagccggacatggtggtacacgcctgtaatcccagctactcgggaggctgaggcatgagaatcacttgaccctgagaggtcgaggttgtagtgagcagagattgtgccactgcactccagcctggaagacagagtgagactccatctcaaaaataaacaaacataaaaggtcatatgacttatgagaattcaagacactaggtcaggatatcaagacaaaaggccaagggcatacctgggtgtactaggtgcatagtgctaacctaatcggcttccagagatattctaaggttaagtttcctcaaataggtaagattttcttcttcgtcagtcccaagacaaactcagagagggttgacttgtaccagccatatcccacttaaggttctagagaatcagacagtcaaaaccctcaaggtgtctgaagtatggggcttgcgtttgcggtggctgtggagtgcaccactcagagctgctggagcagaatgggcacagggctcagctgctccgcttccaatccgccactttcatgccaaggccttgttttccatgagctgctcccagccaattagcggacacaacaagaacacaaatgcaggcctgtttttgcaagacatggaactcctctcacgggcaaatttggctcaaggactctccattgcccaggccagaactttcttacccagtcctctgtccttcccttgatccttccagggatcagaactcccagccccctccatctccccacttttcctcataagtgtttgatcccagtatatctcttgcatatctagttccgttttatcacctgcttttccaaggagtggaactaacacggtattgaaagcaaaattatgtaacaaaatacagagaagtggcttgaaggaacttaggaggaatcccatcaggcccactgcttattgtttaaagcagtgctgtaaacccattcagccccaagacacagcccttcttcttgttggggggaaacttatccaacatggctttatttctccctgtcatttgaggactttggcttccaacgatcatatcttggaaccaagctttaaaatctgctctattcccttcccccatgatttattaatacttttttgttttgttatcctcatctgggtggctgcaattgagtttacttacactctgtcagtctctctcctcaaatttggctacatattataatcacctggagagtttgtttaaaattccaatgtctgatccttaccccataagttctggttcagttggtgtggcagggcctgggcatagaatttgttttaaagctctttaggtgattacattgtgcagtcaggattgagaaccacttctctggctgatgtacagaattattctgcaaaccctgcttcgtgtatttagctaaatttgcaaagctcagcttgaaaactatcaacagaaatttaaaaattatcaatgataatttgcaaacttcaagtactcacaaaattaaaattatcaatgaaaagttgcaaacttcaagtactcacaaatacgaatggctgtaagatgatgtatttcatcagatacagatgtagatatgctagcaggtggcagagcaatatttcacagcaatattgccataataccggaggcccacttcataatgaaattaggttgtgtacgcaactttgcttgacagacccacagcactctttatttgtatttgtgtgcttccagatgtgttttgaggtaattagttgagtgtgatacccagctgttcatgcagtgagcaaaattcttggcacaaatgctgagaacgttggcaatggcctgtggagtattctgtctactactgagttcagtatgcagtgaagtgggcttctgcctgcctatcacccttgtgttttatttaaacaaaccctgcattttctccccgcagagcaagaccggttgtgactgtagatgcccagcttctgctgcacccaatgattatcaatcttgaaaataaaacttgccaggttccagactctatgacatctgctgcctggtgagttagtccggtgcttctcaaactccaatgtgaattcacatcacctgggtatcttgtgaaaaatacagatttggattcagtaagtctggggtagggcctagattttgcatttctcgaaaaaagcttcaagagatgctgctgctgctggtctgtggccgaagtttgagtagcaaggagttagtctttcaagagaacctatgatatgatgctgatctttggctatcgacttaccattcaaaggctacttctctaatctacaggctctaggtgagatgagaagtataaaaacatttggggaaattcccagtcaaacaaatcttggagatagctcttagattcttggtgtactaaaataaacactaaccaaggtaaaaatataacaaaatacctagactcttacattttggcatatgcttatagatactgcttttcaagcacatataatgtcctgtttatttatttatttatttatttatttatttattttttatttattgagatggagtcttgctttgtcacccaggctggagggcagtggcacaatcttggctcactgcaacctccacctcccaggtccaagcgattctcgtgtctcagcctcctgagtagctggaattacaggcacccaccatcattcccagctaatttttgtatttttagtagagacggggtttcactatgttagtcaggctggtctcgaactcctgacctcaggtgatccacctgccttggcctcccaaagtcctgggattacaggcgtgggccaccatgcccagccgatgtcccatttctaactagtcaatttactgggttaatttactgggttttctatgctgacaacagataccagttttgtaacttagcatgcacagctagacagaaggaacacattatacaagatttttgtgccataagctgtatttttttgtctgtcattaagaatagcgattgaattattccttttgctggatgatggaggctttgcttgtactttcagaagctggctgatatgactcctgaaagtgttccttctgaattttgtcagccatctggagggagtacaagatggaacttgactataacacagttcaagaaaataccactgtttcccaatatgtaggtcctcaagagttagaagtcactatgttggttaataccttcagggtataccctctgaaagatcaacaaatccttggggtgtttaatattttgcccttatttttcaggagacgtggtctaactcagacagtatttttggtttctgagaatgtcagaattgcagaactaaccactcttgacccagagaagttatttccagccaattttaacatgttgttgatggccttttgacaggagttcatactggagtcaaagcttttgagggtggagggtggggacttagaggaccctgaagaattctttgaaaaacatcctattgctgggagctggggagtgtggcgggagagcatcctcttctttaactgctcttgaaaagagttggaaaatgccctgggcacatttggttaaaaccataaaatagtataatgaaaacctgatctgagaaaatatgtcagagagccagcgtttatccttacccctgcatgattaaatgaacaatgaactgtgagagttgctacttgttcatgagtattaaaacttcagtatttcccccaaataggctcatgttcacaccttcataacagaatggacttctaggctgaattcctttaagcacatgtggtacactctgatatagaatgttgttgttttgaactagataattgattctaagggtttttagtttaatgcatatttgtataagactgaagtgtgtggttttttttttttttttttaaccagattaagagttctgtttggggccgggcgcggtggctcacgcctgtaatcccagcactttgggaggccaaggcgggcagatcacgaggtcaggagatcgagaccatggtgaaaccctgtctctactaaaaatacaaaaaattagctgggcgcggtggcgggcacctgtagtcccagctactcaggaggctgaggcaggagaatggcatgaacctgggaggcggagcttgcagtgagctgagatcgcaccactgcactccagcctgggtgacagagggagactctgtctcaaaaaaaaaaaaaaaaaagagttctgtttggttttatggaaagaatattactttttaacaagaaaatgtctttcttttcatgagccattttcttactgcatttaatcatattattaagataaagtgcaatttgttatgtggacaaatgtatatccctttacaattatatttgtttctattgcatacatttttctggaagaagtcttattttcacatgcaaaatttgtgaatggtgcctcagagcctcagaagacagaaagttaacagctggttcagtctagaatgtgtttctttgattctcttttttctttattttaggaacttagcttagtttttccaaaatgattgaaaggtctccgttgattttctctgctgttatttgtgtctgtatttgatataactttatatcatacatctgaaaactatcacataaactctacttggcaaatagttcttcacttccatcgatgtggatttctgtgtctttcaaacagcggtgtagttttataaagtatctatctttaattggtatttctaagttagaaaaagggggaaaaaagccagctcaataaatattaatataactggtgactaaccaattacaaaaagaaaaactagcgaaatacttcattttagaaatgtaaaagtgagtaacgacccagttgtccaacctgattaaaaaaacttgtcagatgtgagtgactgtgtgaaacctgctatttgctatcactgaaataggagtgaaaactgatgagaatgtaaaatgaattgctttgtacttttaaatcgtgtttcacatttatctcattttctcttcatcatagacagctgtgagcacagtcacaacgcagaatcattattccaaccgtgcttgggttgggactagcctcagaagatcatgtagtgtatcaccctgccttctggccatatcaaaagcactgtccacaaacagtttaatttagaatttatgtaataagggacttggattgatttgatgggtttttttgttccaatcagacctatttagactaatgggccatactgaaaatgaccaatatttctagtttgaaattttaattctaatttaatgaaagtttacagctttccctaatgacccaagtatactttgtaattagctgtaggcctgcaagtgatcctaattctatgctccatatgacctgtgatgtatgtgtgcttatatataatatagtatgttttcctaaattcagcatgaacacatcagcccactactataaaatcttgaaattttctttagatcataacacagagtttgaaaaattatgacttcacagactcttttccactaaagtaatctattaactggcaggtttaggttggagtgctattattgagaattcagtacattgtagcagtgatattacacttgtatgaaaaaaaagttaaagtcatccatttggtaatgatattcagaaaacagaaagagtgagctaagaaagaaatagagatttatactgacaggtaattcataaataaatagtaaccctttagctgataacatcatttatcaactatataccatcccataaggaaaaaaatgttcatttgtataactttattcctttttaaaaattagttattttgaattgtttgtattaaaaatactgtatctaaaatgattttaatgtatatatgttgataatgtcattacaaataggaatttattttataaaagctaatggctttggtctacacagttaaagatgaatggaaaaaaagatcattggctgatttgaacatacaccaaaatactttcaaaaaggttggatacagaaaaattctaattttgaaagccaggcttactacaaaattgaaagatgtgattaactcttcatctttcttgaataattctaattgaagcagaagcaagttggaatcagtgatttctctggggaagcggaataaacacttgtaatagcgtagacatttcaggaaacttttggcttaatggtatgtggcaaattatttaccctgaggggagacattgactgaggtcacagcagatagatgaatcccagatgtgacactttttcattatatttgacacaggaagctgacacataattaaagtatgattggggattatttactccctttgaattctgtagaaatatccacatcatactatagtattttactggtaaaagtttatgactgtcattaaaccatacttaagtattttcttatattttcactttcctagaaatgtgaaaaggccccatctctagtgatagctgttagggcttggaatttttcagggagaggtgagcactttcattcaacaaaggcagccagggagtcagtcgtctctcattccatctgtagccacagaccaaagccaagtgcagatcatcctataagccagtgcagacattgccttgaatggtagtgatggtgtgttcaaggcacaactccaaagtgtctctcatggacatctgccctctcttgattgtctttattcctatatcattgtgcccacctagcttgagacagccatgctaaacttcctgttttctctttctcccctccctcttctcgtctcaacctccagtcttaccccaactgtagcaaggttctgccaaatttcatctccttccaagcagagtgggtgttttaagttaagcataccatgtgctccatgcttctgaagattaaatctgcattttttagcatgactttcaaagccctgttcctcaccgatccaccaagccagccttgcctcctacgactttgccatcttgctcagtgccccgactacactgaatttcttcagtttcctcaaatgggtccagattcttactcacctccagattttacctctggctatcctcttgctctgctgcctaattcttccctccctggcacatggaagatactgacctgtattcattgaataaaagcaacaagtaattgactaattgagcaactgattaaatcagttaacctcctgtactattttccagtattaccttccatgtaataataatgtcacttgtcttgattgtattagtgttgagatcaattggtagaaggggtgtgtgtgtgggtgtgtgtgtgtgtgtgtgtgtaattagaaatatatagagaaaatgatattcgttatctgggattaggtaaaggaaggcttctactttagattcaaaactttattaaccaataaattactactattttctatagcttttctttaagagtatgtgcatctgtcacaggccagagcattgcaaacacaataggtaagcatgttttcatttttacattcttatggtatactaagaaagttgaacagtaaccatttctctgcacagaccataaaaaaatgaaagaacccttgaggaataccaagatatctgttgcatatatggaaccttctaataaatattacttcaatacttggtaatactattatttataagaacatataattgtagggaaaatgacaacttttataaaaccattataaaacatttttagcttggagagtatgttatacaatttttccagctcatttatcatgcttggtctcaactatgaaaaagaactgtttcctgaataagcaacttgaaatagaaattcatctctctgatagagcactgtgttcactgaatactttttctctactttacttctgtcctttagtcttgatggcagaggtgcaattagattccctgaaacagaaaggagctattaaacggacgctcttccttgataaccatcaggctcatcgcgtcttccctcttgtgataaaaaggcagaaatcccaccagtgccaggatttcatcgtttaccttcgagtaagtattccagaaagacttctctggcctctctccttcatatccaaattccaaccatttttctccatttaaccatcatgtttgtctgcatagacccccatctgtctgttttcattttcatagcaggaaactttattttagggtcaaatactctcctcttgaccctgacttcaactaacctgatgatgtgttgctattaatttctaaggcttcttttcattttgatcaaaatctttataatggcattcagctcacatggttttcatttctacccacctcctccccaaaatacataaaagtgcaacacagtttatgtgaatttttctcctatgtgagtatgtcttgttagattttatcaatgcatgtttcagagccaattcaggaaaatatttaggcattcaaagcttttattagaagtaacttataattatcttatttaaagtaatgtctttttacaatgacttcaaaacctaccgaaattttaaagtaaaaatatttataacacaattacctatcttcaccttgccggttgtgaggttgtgataactgtctcaatttctcttttccattaggggacttagttagcaaggaccaccctagggaagatcacaggttcacaatcacactcaagaatgaaaagttggatacctgacccttgattggcaaacaattgaagggtgacatatccaccgtgtgtttagtgcttgctgtttggtgcttacccctctctactaaaggagttctgtttctttttccaaaagaacttcaaatatcctgaaggtgttctgaagttcatgcaggcaagggcttaaaaagatgatgagaggaagagaatcaagatgttttcttcttctgagccccaagagagaactcataaattctggcaacctcacgaaaataaaaatccaaattcatgatgttttttgtgacatttatgatatacacgtgtaatcttttactttgcaacttgaccagttctgcatgagttgttgaaggtctggagaacccaaagattggctccagaagcgtatttcaatgaagccgcagctctaaatgatttcatcactgcacatatattaggtatgctggctactatataccacataaatcagcctccatctaagcctgctgcaaagataattgtttcatcattcactttcattgagtaaattccagtgttgcctgacttttgcagactgacatcttgcagctatttcatggagcctctgttgagtttgtgattatttttcctaggatgaaactgaattccgagataaattatctccaatcaacattagtttgaattacagtttggacgaatccacctttaaagaaggcctggaagtgaaaccaatattgaactactacagagaaaacattgttagtgaacaggtaagtccttcacagtctttgacggcattttctcaagcaaactctctggggtgttgttctcatggctttaagactaaagccagctcctttcatttttacttctgcatgcagacatggaacatttgggagttttcctaccatgtttcctgaaacactgcatgattgtgtttttcggaagcctttcctcttgtgcaatcaagatttaatttgttcaaaatgtggctgtaatggaagcaatacagcctgtaatcctcaagccataggcagagttgcattctttgcagatatttcagagtgcattggaattgggctattatgtaaagtagcctgtattgggaggtcactgtgaaatgtaggctattggcttgggtagagtcatgcatagtgagaggaaagctctggttccgtttgtggcaccattcagaattttcaagaaaaaggatgtgaatcagattttcctagattgttcctgacgtgcgtttatacaacacaggctcacattctggtggactgtggagaagacaatctgtgtgttcctgacttgaagctgtcggctagaccgtaagtttaaataactaaatgtgtactttctatctaatggaattacaggtatttatgtaaaggttctctggagaaagtatacacttccaataactaccaaaaactatgctgcgtgaaattcttgagcttggctacactttgggttagcctgtggtttgggtcagttatttgtcattggtgtcaaatgacacaccctaagattttgcctgggtcgtttcatctttcagcaaaagtggggaaaaaaatgtttttgttgaaagtaaactcattgatggggtggctcgggttatgtttacttgcctcagtcaagtagacaaaggattcagacaggcaggttccatctacaccttcaaccaaactttttttcagcaccccatgactcaaagccatccttaaaactgtcaaaacaaaattaattttaacttattgaataaataaacctaaatagcactctatggagtaaagcagaaggtgtcacaaaattgaaacgaatcaaagggcttcacagttgccagtaatggacgcccccattccagcactggaaattgcactgtattctgttatgggaagacatggactaggatgtaaaacattctgtggtcaagaaacagatttgtgtttctttccctcccaggaactatctcactgccagtgtttggaatctgcttggtaacttctcagagggacttcccccaaatttcataatttatcaacttcaaatgcaatcgctttaagtaaggttaaaaagtggagtaggcatttccaactattggcttgatttgcagttctaagtgaactgcatgtcttcaaaataccttgaagtcctctaccagtgatttaagatcttattgtatctgcctgcttcttccctctcattatttcctttgcattaatctatccctcttactttctaaaccacctctcttccttttattccattgcccattttcttcctaatgtatgttttcagtgaagtgctgaagctgcttcattctggcttgtaagtgaaatgttaaatttgcagtaattttgttggtagattgttaaatatgttggtagcttgaaaatgaccacggttcatggatttacaccactggaatctgaaaatgctataaatcaatccttttttttttttttttttttttgagaactggttgttaaacatttaccaacacactactgggtgttttcctgccctttttacccagagatgattctcttgcctcttcctaccatctcttcatgatggtccatcttctttttttgcacttgccatttttcttttcctcctctataaatccttaaataaaatattcacgaagccaagaagtagagtacctaatccttctttttaaactgcatttttagagataagcatcaggtaatcattggagatgaaaatcaccttatgctcataataaatgcaagaaatgaaggggaaggagcatatgaagctgaactctttgtaatgataccagaagaggcagattatgttggaatcgaacgcaacaacaaggtaatgcctgcaaattgtttgaagtcaagagctaggtatatttttgaagtcaagtaaatgttaagaagggccatcttagctgagagtttcttccttaatgaaagacagcaaaatgataccttcttttgttaaatcataacagcaatgagccacaaagcaggggtgggcttacacagtattaatgtctttctttgccacagtgcaaagatagattggccaaagattgagagctaaagcaaaaaagagaacaagactggctgaaagaagaagcttaccaatgcgatcaaaaagctaaactcccaagctaactccctgtcttcactgacttttctagccttgcactgagttcctatcagtttcaagcacatgtcaggaagcctggttttcgttattggttagggaagaaggtccagccaatccctgatgagcactgataaaagcctggaccgacacaggaagggaaacaaggtcctttccctttcttcttggtccaccttgtcagaattatgaccaggaacagcctggtcttcctcatttgccattcctcaatgccactatttgtttaaatgacaacaatgctatttatagtcttccccttccttatcagaacatgaatcttcccattcaaagcatcctccagttctgcagtgtccttaatcacttggtctagaaaactattaaaaatacattgtagaataacagagaaagtccctcagtgtctgaaatatacaaactcacaattaagggtaaagcccaagtttcacgtttcctttcataggatgaggtgtagagtaggtgctccttaaatacttgctgatagcattgttcatttagcttaaatgtattaaatgtctactagtttccaaataccacaccccctgaggaccttgtccattttaatgattgaataatgtaatgaaaagtaattcttctaaacagatgttaacaaactgttgttgtgatgttggtattttaaaggcattaaaaaacttagggaatataaaattctctattcacacttctagtctcatgatttttgtttgttttagttgaacgatcttcttagtaaaaaacaaaaaattaaaaaatctagatgggtaatgatagagcatctttaacagtcatttaaaatccttgagtatctgttgaagaaatgtataagaaaaaaaaaactccaaagtcatcaaatgttatccattaaatatgtactgctgttttgtgtatgtcagtcacatcttaataaagtagtttttaaaaaaatagtcctaaattattcttaactcttccatgttgacagtgaagttggatagaggggaaaaataattccatttcttttcaagagtatttgcaaatctccactcagctttcatttccctgttatttcaaacatgaaaatcagtataaaccctaatttctccagtgagtggtttataatcatcccattttcttctttcttgtatttttttttttgagacagggtcttgctctgtttcccaggatggagtgcagcagcgtgatcatagctcactacaacctccgattcctgggctcaagcaaaaccctcatctcagcctcctgagtagctaggactacgggtgtgcaccaccatgcctggctaatttttgtattttctgtagagagggggttttgctatatggcccaggctggtcttgaacacctggggtcaggcggtccacccaccttggccttccaaagcgctgatattataggcacgagccatccttgccccgccaattatgtgattttttttaatcctcttcatttctctattaaagtcactttaagataaaaataaataagaataaaggaagtaattatacacacaacttataaaaatggtgtttaataaccactttgatttgaagatgtcatttcataataaaatctctacaagcaaaaacagaaagaaaaatgacgtctacaaatacttacctgcagataacgcataaacaaacacaaaaacaaagcttgagtatgttttgtttttaatattccagagctccactcatatttttatttcaattcccttcttgtcactccacccctgacttcactaaacaaaggacctattctaaaatgttcttttagcagaacatccagtttactgttggctttgttgcatagaaaacacaggagagcacttaggagtctatctttggctgtaaacattacaagggacattatctgcaatctcaaatgattccttcactacttttttctctgtcaatttccctttggcagagacttcactcagtctttgaattttacgtgactaagccacattctaatttcttccttgtttggaaacagtttgaggtttgtgtaccttttgatttcaactcagttcaagattttttaaccattttttcctcaaggggaaaaatattaggcattatctgattgtaaggttggctattgttttgttgaaaacattcgtctttttagaaaatgtaaatgcttatcatctcttgctctaggaaaccttagttgagccagcctttatatttccttttggtgatttttctccttaatttttctgtgaaaaaaggtgtatatgttttatatttatcatcatcatcatcatcattatgatagtagtaagatacatgtaagatataatttatcattttagccattttcaagtgcgcagttcagtgacattatatttacgtggtagtgcaaccatcagcactgtccatctccagaccttttacatcattccaaactgaacctctgcaacccttaaaaataattccccattgctccctctccccaggccctggtaagcaccattctactttctgtctctgtgaacgattctagggacctgttatcatctcttgttcagtctctcacagccagctcgccttcagcatgtctgtatccagacttttggtcttcccactcacacccctcttcccttccattttcttttttctttccttttttttatggagtcttgctctgttgcccaggctggagtgcagaggcatgatcttggctcactacaacctctgcctcctgggttcaagtgattctcctgcctcagcctcccgggtagctgggattacaggcgcccaccaccacgcctgactaattttagtatttttagtagagatcagtttcaccatattggctagactggtcttgaactcctgacctcaagtgatcccccagccttggcctcccaaagtgctgagattacaggtgtgagccaccacatccagcttccctttcattttctatgtacaagaatgacatcagcatcccctggcttctaatacctaaagtgatgccagcctggatgagggtgatgacagtagcagttggatggagagaaggatatgaactagagagattgtggactgagtccatccaacagccactgtcaccaccttcatccaggctgccatgatcttttgcccagattattgcaacagtcttcctagtttgtcttgccaactccttacctctaacctagaaaaaaatccatctttctaaattacaaatctgagcatggtactgtcttcaaatcctcactagctccccattgcgttgaggataagatccaaatccgtcagataatgcatgagacccttgatcatatcacccccactcacctcttcagcctcatcgctaaatgctgacgcttccagctggcttgagttccttttccattcctgtaatgacacggagagcttgttccagccgtttctcctcccaacacactaactctgctccctcatcctctttatctatcctacttattttcaattctttctactcatccttcaaataataattgagacttaataaaaattgaggcttaataatagttgagacaataataattgaggtggctaacatttactgaacaactgctatgaactgggtaattctctgagttcttgaatgtatttcattcttttttttttaatagcattaggagatatacctaatgtaaatgatgagttaatgggtgcagcacaccaacatggcgcatgtatacatatgtaacaaacctgcacgttgtgcacatgcaccctagaacttaaagtataatagtaattttaaaaaagaatgtatttcattcttataacagccttatagagaagctgctgtcactatccctgttttataggtaagaataaattaagtaacatgcgcaaggttatacagctattatgtagccgaagcaagttcaaacatcaactgttaggtccaggcccctgtttgttttgttttttggttttgttttgtttttttgagatggtgtctcactctgtcacccaggccagagtgcaatggcgcgatctcagctcactgcaacctctgtctcccaggttcaagcgattctcctgcctcagcctccctagtagctgggattacaggcgccagccaccatgctcagctaatttttgtattttcagtagggatggggtttcaccatgttggccagactgctctcaaactgctgacctcaggcgatccacctgcctcggcctcccaaagtgctgggattacagatatcagccaccatgtctgctgggcccctgttcttaaccactgatatgcactgcccccatcagcttagatgccacttcctccaggatgccttctctgattgcttggatctatgtgcaggtcctcctttgtcactatttatttatcctatcataaaatttcccaactctgctgcaattgtgtgtttccactgctgttataattgcttagaattacttgttacgttgttaaaataattaagaattcagtgaggacaaggggtctcatttgtcaggcctggtaaatagtgggtacacagttaatattttcagtgaatgaagaacactctaagagctataaatggattagaacaagaatgtcccagaaactgcagaggaaaataatctagaaatgtccataaaaagtcattgttcctcttattaacgagaggaaataatgcctaaaaaaagaaaaagggtggaggggatgtgaaagggagaaaaaactctttgagtgatgtcaaagaactatttccagaaaactggggaaaaactgtacatataacttttaacctttaggtgagatttaaaaaaaaaaatttactatagaaactaaatccttgaatgtaattcaagggacatatgaggacttacggaagatttttctgggttttgttctttctgttttcatgactgagttaataatcccaacacaaagcatctctgtatgattagcggttagttatggatccttaaggagctgaagacatactaaacctaactttgagaagaaagaatattaccacctttttgaaaagatgttttttagctcatccgacgtaactaactgtctttcaggatatttgaagagaggatgtattaaattgtgcctccaaatattagtgatccattcctttctcaataactaggacagatatttccatgtgtctgtgtatctggggattctgggggcagggttttatacttggttgcatacttgtctgtttcattgtagccttctcttttacaagaaagtgtcagctgcctctactctgttgttcctgaaccatcacttactttgtgtccaagtttgctctaggcattaggactagaacagacacaaaaacctctgccttcttgaagcttatattctcaaagtgtgtggtttacctacagaattctttagctagatgtctggggaatgtttcatgttttttgcttgggttttcggtttgggcttttgttaataaaatagaagggaatggaagatcatttctgaaattttatattattctcttacctaaaatttcaatagataacagacaaggacaaaaaaacaaataaaaaataaaataaaatttcaatagagctgacagatggataaatggtcattatattgagaaccctcttccgaacctatcacagggacagaaattccccccaaatttgctgttttatgaaagtcctcatattgcaagcttaccttttggaacaaaggtgatggataatatatcgatggcacataacaagttagactgaaataatggaaaaatgtaagtagctatggctgcatgcagagtgggaccatagggtttgcggtatgggaaaagaatagggtagagagtgaggggtgggtttctgagcaactgggaaaagcatgcggacatgaagaggagctggaagccaagggcaactgttccagaacaaatctgtatttcccctctcatctgttcaaccttgagaatttgtccagtatatagcttcaagaacctcttctaacttcagtttgtatgaactctacttggaataggatataagggaaggaaaggaaataggaagtactgctaaacatgaaggtattctctttacatctgaaatactgaagaacagaagaaagtcgattgcatgatctcaaaacgggaccatggtgtatagaaatttgtgttcaaggcaattatctggcaaatggtcattgaatcatatgataatctatacacattatgatcattttgtttttggaaggcttaatagaataaatttatttactcatgtttaataatttgtgattttcatgccctgagtttcacattaatcttagtgaagatattgtctaagctatttatataaatactatattatgcattgtcttccttaatgaaacacaataaatatgcttacctacccaacacatttatttctaaaatttaacttttacttttctctctccattttctcttctgagttaagggtcatcaattactttttttgcactatcgccctcctgggtgtttgagatccaggggagctcccaggcccccagcatggcttttgtgtcaggatgtcatttatcctgccccctaaaccccctgttctttgcaattgtagggatttcgaccactgagctgtgagtacaagatggaaaatgtaaccaggatggtggtgtgtgaccttgggaaccctatggtgtctggaacaaatgtaagagagaaccagaaatactgactgatttccttctaactggacttcacagggaacaaatggaaagctctccagttaccactcagcaactcagcacctagcagcaacaacaaattaggcaggaaattgccagagtagtgggatttcacattataacctacacagagtgaatcgtctcaagctaaaaacacagaaagatgcatgctcttctatgctttctctttatacattactcttgcctgtcttttagttacaacaattttatacagactttgtttttactatagatattttctttaaatactttttctttgaattcaaaaagaaatgcaatgtaagttaaagactctaaaaataaccaaattaggacaaagattttagcaatggcaattaaaggaaggacatgacattcaacagtgaccatagaattcccttttcaagggagattcaggtacgtatttgcattttaaagatgctgataagtctttcagttaataaaccttttagcctgatgtttcatacttttgcttgagcatttgaaacttttctcaagttagaatattatgctagaatgatatttttgctcttttatgctataatgttgcgttgatcttgggtattcaaaaatgtgctgaaactacagtaagctcacttcttggggcaaaaataaataaatatttcaatggcaagtacattcccatgacatattattattggttaccatggattgattgtcctctaggttataaacgcatcgctgggaggaggggagttttttacgttattttattgaattttcaaaacaaccctgtgagtcaagtattttctttattttatggatgaggaaactgaagctcagagaagtcagatgaattggccaaagcctcacagagggtaaaggttagaacaagattcaaaccaagtcttacagcaaagcccatgttctatcccgtctgcaacatggtgaaaagcccttggataaaaaacaaatgaataacagatgagacttcaaaatgaagcattgaaagagagaatgggatgtttacactgagatattagaacatttttcactatcatagtccttttatctggaaggtaatgaatcgttttgctagttttttgagaaaaatccaaccgcctattttattttattttgagatggagtttcacgcttgttgcccaggctgaagtgcaatggcacgatcttagctcaccgcaacctctgcctcccgggttcaagtgattctcctgctcagcctcccgagtagctgagattacaggtgcatgccaacatgcccggctaattttgtatttttagtagagacgggggccaggctggtctcgaactcctggcctcaggtgatccacctgccttggcctccgaaagtgctggaattacaggtgtgtgccaccgagcccagcctcaatggcctaatttaatatgaagagggttacctaagacaaaagagaaatgaattgaggtggtagtaacagtgtcagcatctgtagatgatggaccactcgttcctttttcagtattagaagtgttacagctagaccagaggtcatctaaggataatcttggaacaaaactggccaccagtatcattcaaagtggaggaaaaatggcagtgtggtcttaatcacaaatgtgtttatgtgaaagtatgtcaattcattttgccagcaaatagtctttagaagtcagggaagtaaattgtttatattcatttatctctgaggtctatagtaaaagaaacctaatagctttcttatctcattctttagtgcccttaaacacatcaaattttattgcattctgttttgttataaaacactttgatttatattcttcttcattttgtactctacaaagaatactctcagtgggttgtggtaaaattccaaatggaaaagcagtgctaaagattttaaaagcaacataaattgccaggaatgtttagttctatctattatcttttaaaaatcactttcaagtgacttggtattttaacttaaaaaaaatattcaagatagtattcagaagttttacttctgatttttaaatagtaaagtcatttccatagagtagctatagtaatataagatgtttacatgccaataagattcataacaagttgcaaattttctcatgggaaaatttttttaaacggtggggtcaataagagcgctttaaaatcaatgccatgagatctggtgtttggtactagttaaggacacatgcacctcttaccagtatgaaattgtcacaccttcattgggtctttgtcccatgcttattgttctataatgaaaaccatcattaggtagcctctatcgcaatacaataaggtttctatcactggaaataagcaaacaagaacaaactctcatcattcttttggcattttttttgttttgttttgagatggagtctcattctattgccctggctagagtgcaatggcacaatctcggctcactgcaacctccacctcccaggttcaagcgattctcctgcctcagcctccggagtagctgggattacaggcactcaccaccacactcagctagtttttgtattttagtagagatggggtttcaccatgttggccaggccggtcttgaactcctgaccttgtgatccacccacctcggcctcccaaagtgctggaattaaaggtgtgagccaccctcacgcccagcctgttttggcaatttttattgcactgcttctatatgccaggttctaagctagagtcggcaatataaagataaaaacatacaaccttcactcaataagaaactcaaaattagcagtgtcataagttgagtggtggaagagtggtaaaaaaggagacagagaataaaaaggagaacaattctgcctggcccagcccatagaatcagagaatgtattgcaggagatatctcctgtcccaagatttcaggcatgcgttagcagttcttcaagtagaaaaggcaagaaaaagctaaaaggcttctaaaaaggagagaagagcctgacagaaaattgctcctttggaatttttaaaaaaattcatccggccgggccctttggctcacacctgtaaccccagcacttggggaggtcaaggcgggcggatcatgaggtcaggagtatgagaccagcctggccaacaagatgaaaccccgtctcttctaaaaatacaaaaaattgctgggtgtggtggcacacacccgtaatcccagctactcaggaggctgaggcaggagaatcacttgaatctgggaggtggaggttgcagtgagctgagattgtgccactgtacttcaacctgggcaagagagcaagactctgtctcaaaaaaaaaaaaaaaaaaaatctttgctggggcgtaatgccttagcattaaatactagctataccagctgtgatactttgagcaagtcacactgaaatgagaaaacacctacctgtaggactgtttggagcaatgaatgatatgacaaatgtaaagccattcggacagtacgtagctcgaagcacattcggcaagggctggtgaactggtgctgctgatttatgacaaaagagatgatttattattcgttcatattattactgattcatgtgaatatgagttttggttaatggtttgattctgatactatagtggctgtgataacagatttgaaagttagcttgcagggatttaaattctagctctgtgatttatttgcaatgcacctggagcaaggtacttcatctctctaatcctcaggttgctgctcaattgtataatgtcagcaacaacagctcctaccccagagtgctttttgggattacatgagatcatgtgtgtaaggcatagtacagtgcttggaagagtaagtaacataatattacagatgtgttaactattatttttacttccttatttatatcatcattgaatttattttccccatgtttttatctatttccacgttatgaaaataataaaagcagttttaaaaatttggaaacctttaaaaggaaaaagtaatccatgtaactgtaacctcaactagaacatattattctgaaatgttttcctatagcgcatccgcactcctgtactgtagaggaatttttcgatttgtagacttttaaaaccaaaaaccatagctgacgtgcattgcacataaacattgtaaccttcactcattgttgattgttattacattagaagcattttccatattgttgcgttgacttcacagctataatttcaatgactacataaatgtccatcaaacagaagcatcatagttttctaagtcaatttctggccaggtgtggtggttcatgcttgtaatcccagtactttgggaggccgaggcaggagaattgcgtgaaatcaggagttcaagaccagactagactctgtctctacgaataacaaaaaagttaaccaggtgtggtggtgtgcacctgtgacccttgctacttgggaggctaaggaaggaggatcacttgagcctgggaagttgaggctgcagtgagccatgctcgcactaatgcactccagcctgggtgacggagcgagaccctgtctcaatcaatcaatcaatcaatcaaccaatcagtgtcttctcatatatttggattattttcaatttaacacacaaaaaggtggcaggagaagaggcagtataggactaaatggagagagagaaccaacctgtactgtgacctgaatcttctggggcctgtagttcattgcatgacttctcttggctctcagccacctggggtagaagcagaacaaaggaaagagttacagtgatccagggtggggttttgcaggaatgacttacaaaatatttttatgttgtgtacaagctactcttgtgtgattttattttattttttagtattccctgggcctccgatttgcagttccacgtcttgagaaaacaaacatgagcattaacttcgatctccaaatcagaaggttagacctttacatgcctatatcgttgacagcagtcaaaagaaaagagatccacagtgaaatgatgtcatctgtcaaggcccttggccttaaaagctcacctgaaattagaacccagactttcacagcccatttcttctttgtttttctcaattgtttcagtaatttcaacattttaggggttttgaaaaagagattgaattatacagaccaagttatgagatagcaaaattttgtcctgggcaccctcccacctgctttacttccacttttcctcattccaaagcacatgtctttccccaccctaattcccatgctctcagctgggcatcagctagtccctgagaacaaagtctgtgaaagaaaaagcatagattttgcaatggccatcctgaagtctcttcaattttcaagaatgaatgaatctctgatggcttacctatgcgcactgtggcaggatgcaggtgagatactccattttgagggcaagcccttctctagcaatgataagcagagccatataggtagctgcctctcttttctaaggctgatgctgtttgagaattcagctgtaactttaccctcttaccacctattctgtctgctcctttgtggctgaaaataatatttcgtgaacaggaagacctgaagaaagtagtagtgtggcatttgggctggggcttcccagctgtgaacttaaacccattggctgggtaatggaatcagtttaatggctctagatccacattaaaaggaaattgaatggaaagtaacatataatataatataatataatataatataatataatataatatatattaatacagctcatgaaatattcctttcagtaagtataaatatgtgtagtaagatgtctagtgagatgtatgtattttttgtggtctgcagcttaaaaagtttgaaaatctctgatgtaaacaggacatgaaagccttctatatttatttataccttgcctggcatgttgaacccttgctctaactattaaatgaatatgaagtcagtatccacaatttgagtctcaaatactagtgtgcaagatggttaatttctaagtttatcttaatatcttgcaagaagtaccattagagtgtgataacttttagaataatgactccatgcaatggattaatttttaaatagctacttcaataaaaggcttaggattttttaaaaatatataaactctgtaagaatgtagcagattttaaaaatccacaacccatgtcacaaattattctcccaccccaaactttgtatagatttctagagaggaaggttttctcaacttacttgagctgttcatttctgaccttaatgaaatctttcttgaatttaacttagacattttctgctgaattttaggttcttaaaatctggataaaatttagtgatgggatacagatggaataaattcttctgtaatattccttcattttaccaaaagcatgttaaatcatttctttgtatctgtaaaaatatatcaaaggtttaggtagccctaaatatttttattttggaaatcttctgttgatatttctaagtatcttaagaaaaaaaacaaaaacaaacaaaacacgtcatggcaaaggaccaccatccctccagacagtaacctgaagtttctattcctctgcatcattgtctgtgccattgatcctccagtgacatgaagctttgtgtcacctgtggaaagatacatctctcataaaatacacaacctttatatagaaaagaagtctggtacaaagcaaattcattgatatttcctcctcgctcttggttgaagttacaaaagagaatggatgcaattactagttcatctaagaagcaaaagacacaaggtagtgttctagatggcttccccgagtccatcctgtagatcatcattgaaataatgaattcagtaatgaagtgccgaatttgctgtaaagtagaagtggccacgtttttaacattccccttcatctaaaacaaagggtcatgactgattacattccatttctactcaggactattttaacattacccttaaaaaatataaagatgcagaaatgcagaaagaactggaatatacatacagcattaaattcccaaaacatgtattatacatataaaagcaagaatacagtgtttgaggctgggcacagtggctcacgcctgtaatcccagcattttgggagtccgaggtgggtggatcacttgaggtcaggagttcgagaccagcctagccaacatggtgaaaccttttctctactaaaagtacaaaaattagctgggtgtggtggtgcacgcctgtagtcccagcttctctggaggctgaggcaggggaatcacttgaacctggcaggcagaggttgcagcgagtcaagattgcgccactgcactccagtcagggtgatagagtgagaccccatctcaaaaaaaaaaaaaaaatacagcgtttgagtaaaacactgtaaaaactcaattactagggtatttgagaggtgagcatttatctgcatgctttgctggctgactccaaagctgtaaataaggatctaaatggatggttttgcatttggtttaaatgtgtttaagccaaaaataaattaaaccaaatgttctgaagtctaaactcttacaggcatatattgactgccatgacctgcatttaatgaatcccttttccacaaatagaagtcaagagagaaatgggctttatatgttaataaacttaaaatatttcctgttaccaaatatttgcattaagcggtctctccatgccctcactctacacgacataaacattttcctccctgtgtacaacgggtctcagattgcaattgccacatacaaacaggtcttggtgactgtcctcagagtttcttccttagtaatggtgagatgaatactgtgttatctttgctgacattccaaagaccacagaaagcatagagggaatgttagaatgcaggaaataggaaatagtaaggaaaaagaaaatagcattggagtaataaagtgaaaaacatgtctatccatagtatataacatagggtgcagttgtagagaggaaattcatcattccttgtgtagaaccagcaccaacagtttaaatagttcagcttccatggcggtgatggatggcttgtttggatgtagcagcggtattagtgagggagctttcctttcaggaaagaggtcaaggaagcatccaagttatttctcaagcctggttcctttcttacaagagatattgctgacaccgctagtatgcagtagcaagtgtcatggcaagtctgtgtgacaaaagatgattttgattagccgaccagaaggtctggactcagagtttgctgctgttcctgctgcatttcaaaacagcctctaaaagcctcatgttagattgttttcaaggatgatttcaatgttcaatgtctatttacatactcagagtattgtgggtaatgaaaactgtgttattgaaaccacttgggaagaaaatacaatagaattatgcaataacttaaatgaaactttgttttttcgtaattctaatttccacggctgccaagcagtagtgaactagaaatagaaaaaagtctggttaatctgtggcacaaatatatttaaatttccaaactgaagaattacccataatatatttggaaccataaagtctacaataagtaaaattacttaattacttcttaatggttagaattcagaacactgccttaaaaacacacacacacatttgtttagttgactgatcccagatgtgatcttaataaaatggcctggaaactggggttcagcctctggtgaacaagtcccttaagctcggtcatgggtttagtggcgatgctccattccaggaaatgagcctgacatttgcctgtttatatcttttatgtgtggttgcagtttaagttgtcttatcattatatacaatcggccaggacttttcaaaagcatcatgggaacaattctgccgcctcctgctttgaaagcagaattttatcatatcctttccagctctcgcatttggaaagcttcaaaagctagtcacaacctaccgcattaccatcatcttggtgctagagcttgtccatcgaatcagagtgaggtttgatgatgaaaaaagaggaggccttctcttcctaatgacacctgaatataaacatgacctgttagtggtgatgtggctgtgtctcggtttgctaaaagctgcctaagtttttagtgacttcagtaaaagcataataggattataaaattcagatggaagctacctccaaaactcagttactggttgagcctctttgtgaagtacgttttattttccttatagcacacacattttgaaacccatgcatttttaaaagttgtttcatatctaattatatttgctggagagaaaaaaccccagcaaacttaaaaaataattttgccactgttcaaagaaatgttgttaaacacacaccttctatctagacactcttaatgcattttgtaaatatccatgtcatctcctaattgcctgtttatgaactggccaacttccttgggtctatattcagggtattgtgggtaatgaaaagtgtgttatttaaactggtcttttaaaataccctccaactccttgtcctagttagctggtgagtatgcagtgaatatatgcttattttaatactaactgaagaaataaaccgttaggaagatgaaattgctgccaagccagtgcatggtatgatgcatcccagagccaaacacaaatgctgtttcgattatgtatttctctgcattattcatgccagttcttctctttattagcaaggaaaatcaggagttggctgtgttgttacttcctatttaatgggcaatgaacatgatatgcgcagagatgttaaggaatttgtcaaaggtagaagctgcaaaatgagctcagttcaatacatttttggtttagccatttaaaaaagtgttagttttggctgggcggggtggctcacgcctgtaatcccagcactttgggaggctgaggtgggcagatcatgaggtcaagagatagagaccatcctggccaacatggtgaaaccccgtctttactaaaaacacaaaaattagctgggtgtggtggcacacgcctgtagtctcagctacttgggaggctgaggcaggagaatcacttgaattggggaggcagaggttgcagtgagctgatattgggctactgtactccagcctcgcaacagagggagactccgtctcaaaaaaaaaaaaaaagtgttagtttctttagatatctattgtatttccagataaagtgtctcttcatagacagttgttacattactattgatcataaaagatcttagcatttctctgtacaaatggttacgattttggagaatgaatacacttgtatcctgaatgatcaggttagtaacgtgtgttctcctgtgatatgtagaatgttttttatgatcatatattgtaataatactcctgagcagatagatttaaatcacatgtccttgtgttttagttccaacaaggacaatccagacagcaattttgtgagcctgcaaatcaacatcactgctgtagcgcaggtggaaataagagggtaagtagtaagcaatgcatagtacaatatccttctgtatgtagagttaagataaaatactagtgaaaatgatgtggaattttcctgatgcattagagatcacagttcattttggatattaattttcactcttttctactgatcgttattagccttccattggaaagcagagtaaaccctaaataacaattaactccaagaatatcaaaacaagaaatcactttatgccaggcgcggtggctcatgcctatactcccagcactttgggaggccaaagtgagcagatcacctgaggtcaggagtttgagaccagcctagccaacatcgtgaaaccctgtctctcctaaaaatacaaaaattagccaggcgtggttgtgggtacctgtaatcccagctactcaggaggctgaggcaggagaatcacttgaacccgggaggcagaggttgcagtgagccaagatcgtgccattgcactccagcctgggtgacaagagtgaaactccatctcaaaaaaaaaaaaaaaaaaaaaaaaaatcactttattccccaaattgacagtgcagtaatcaaactataaaaaccagctgataagaagccagataaaatagacaaccatgtgattccctgaaaaaaaatctcaattctccaataattattttagcgtaatgactttttagccttaccacaccacatctggagtttaataaatgactaactctcagatgcaagggtcgattggatctatattttacatcttttttctttggtcctattctttaaggaaggtgccaataagcaatcaactgagagacgggggaaaagggtcaaggaaatgactaccagctgcaaaatccatgcctgggggaaaaagaaatcagaaatgggttgtgtgtagttcttatcttgcatgaaattggacttcattgatttttttctgatgattctggtttttcagaacaatcatggatttggctaaaaatgtcaactggtattttggaccaagttgtcactggggttccagaatgctggtttccttccttttccacggtggtttacaagcttcgatgatgacagctggtatttcagcaggcagagccagtgctgccatgggtcctgccctgctgtcctggtgccgctggggcgccccctagcggattagagaataatagcaatgtctaacatacactgttcccttctgggtgctactccaagttagcccatcttataaatgaactagtatcctccttgtacaggtgagggaattgcggcacaaggagttgaaggttaaactagaaaatgccagaatgtaaatataggcaactgtctccagagctcatgctcagaaatgatcatgctatcctgcctgggatatagttttttgaaacttatctacataaaatcgtattttatgtatgtttctaatttttttccattcaaaccaatgtttttgagattcattttagtgcacgtgcctgtaattcactcatgtcaactgcctgagtgttacactgtaaaactataccatcgtttatcttattttactttgagactgggtctcactctgtcacccaggctgatctcggctcactgcaacctccacctcctgggttcaagtgattctcgggcctcagcctcctcagtagctgggattacaggcatgcaccacgcccggctaatttttgtatttttagtagagacagggtttcaccatgttggccaggctggtctcaaactcctgacctcaggtgaatctgcctacctcagcctcccaaagtgctaggattattacaggccttagccaccatgctcggccaaaatataccataatttatttatctattctactctggatgaaaatgcagggcttttattattttcctttttgcaattgttttttgtacatatcttccagtacacagggggaagaatgtcagcagaggatatacttagaagtggaaattcaggatcagagagtatgctctatttaactttactacataatatcaaactctttttcaaaatacttatgccaaattacactcctgtgagaagtgggtgaagtttctgttatcccacactatcagctaactctcaacatgatctggtttttgagccagtctggtggacaagaaatggtaccttactgaaggtttaacttgcggtcccctgattcctaaatgagattcagcagctttttaatctttgttgactctttattcttcctgtgcagagaaattcttgttcaattttttgcacatatttcttttcttttcttttcttttctttttcttgacagtctcgctgcatcacccaggctggagtgcagtggcatgatctcagctcactgcaacctctccctccagggttcgagtgattctcctacctcagcctcccaagtggctgagattacaggcacctgctaccatgcccagctaatttttgtatttttaatagagaaggggtttcaccatgttggccaggctggtctcgaactctgtacctcaggtgatccacctgccttggtctcccaaagtgctgggattacaggcatgagccatcacacccagccttttttacacatagtgctactaaaagagttgactttttttcattagtgtatagaaattcttttctattctagagtttagtcactaatcctttatcagttacaaagattaccaatatctttcaacagtttatggagtttgtggggtttttgaaaagtcagatttattggaatgtaaattacataaagtaaaattcatcctttttaggtgtccagttgaagaagttatgacatcaaaagaacatacaatatagaacagtaccatcactccacatagttattttggactactttatagccaacccttccccaccccgagaccctggcaagcttggcctattttctgtcactatagttttgcctttttccggaatgatctataatgttatgcaagtcattgggaatggtgctggcttcttccacctaacctaacgcacttgagaaacatctgtgttcttgaatgtatcagtagacagtttctttttatatatatacttttttattattatactttaagttctggggtacctgtgcagaacgtgcaggtttgttacataggtatacaagtgccatgatggtttgctgcactcatcaacccatcatctacattaggtatttctcctaatgctatcccttccctagccccccatcccccagtaggccccgctgtgtgatgttcccctccctgttgtccacgtgctctcattgttcaactcccacttatgagtgagaacatgtggtgtttggttttctgttcctgtgttagtttgctgagaatgatggtttccagtttcatccatgtccctgcaaaagacatgaactcatccttttttatggctgcatagtattccacattgtatatgtgccacattttctttatccagtctatctggatgggcatttcagttggttccaagtctttgctatgatggtttctttttactgctgagaagtattccattgtatggatggatgtccagtgaattgttcatccattcactcattggtgaacatttgaattgtctccagtttgagctatgaagaataaagctgctataagtattcatgtgcaggtctttgttggaacatttgttttcacaaatggaattaccgagttgtatgatatgtgtatgtttataagaaactgtgcaactgttttccagaaaggctatactgtttccattcttcattcccaccaaccatgcatgagagttgcagtcatgcaccatttttgccagcatgtgctttatgttggtttgtatttagtcattctagtaagcctatagtgttccactgagtttttagttttcatttgcttaatgaccagttacattgggcatcttttcagtgcttatttgccatcaatatctcatttttggtgaagtatcccttcaaatcttctacccatttattactgggttttctgtctccttattatcgagttgtagaagttctttataaattctgtatacaaagccatttaccaaatatgtgtcccgcgattattttctcccagtctatagtttggttttatatttccttaatagtgatgttcaagaagcaaaagtttgatgaaatccagttgattttttaatgttttgtgttctttgtgtcctaatttgaaataatactgttccaaagtcacaaagattttcacctgtattttcttctaggagttgtataatttcagcttttacacttggatctataattataagctaattgtatctggtgtgaggtgagggccaaggttctttttcttcttttcttcttttttttgagacagggtctcactctatctcccaggctggagtgcagtggcacaatcaaagctcactgcagcctccaactcctgagctcaagtgatcctcccaccacagcctcccaagtagctgggactactggcatgcgccaccatgctgagttaatgtttaaacgttttgtggagatgaggtcccactgtgttgcccaagctggtcttgaactcctggcctcaagcaatcttcctgcctcaccctcccaaagtgctaggattacaggcatgagccaccgtacctggcccacttttacacatgaatacctagtgccatttgttgaaaaaaccatttttccccccactgaattactttggcacctttgttgaaaatccattattatatgtgagagtctatttctggatttgctattctcttctattgatgtatgtatgtatgtatgcacatctttctaatctatataataataaggcttgaaatgtaggagtgtatcctgagattttgacaaattcatttgtaaattccagtagttttttgtttgcacatttcctagtatcttctataaaactatgttgtctgcaaataaagacttttttgttattttcccatctgcatatgtaaaagtttatccaattataaagttagaggggacagtccccacacgagattacctgcctttttcatgccaactgcagattcaggtgattcccaaaaccaccctcagggtcaaaacttcagtagaagtacacagaactcattgaaagctattacacttacagagattattacagggagaagagacattaaaatcagccaagggaagaaatacacactgtggaatctggaaaaggaccaaacacagggtttccatccttctcccctgtggagttaagggatgttacttttctgctattgacatgtgataataggcttggagtatcacctaccagggaagctcacccaagcctcagtggtcagagtttttactggggttctatgacataggcatgattgatcatctgcccatgtaattgatctcagtctccaagttgattgatatgatgtgaccaaagcttccactctatatcacattgttggtctttctggtattaacaacccctactctaaatcatagtgttaggatatccattgtgattcaaggccccaggcaaacaaagatattcctatcaggcataaaattccaagagcttactcattaccccccagaagctgagggcaaaggccagacctcttcttggacaaggttaaattatttgttacatacttatgcctttcattttttttcttcccttattgcatagactagaaccaccagtgcatgatcaatagaagcggtaaaaagagacatccttgccttgttcaattttacaagaaaaccattcagccttttactatcaagtttgatgccagctgcagggattttgtggacaccctttatcaagttgaggatgttctatcttatttctacttaagaatttttaacatgaatgtatgtttagtttttttcaaatgcttattctgtacatatgaagatgattaaattgtttttcttttttattcattaaagtggtgaattgattaatttttggttttgaattttaaaccaatcttgcattctggagaataaacacatttagtgttgatgattatcctttttagatactctgggattcgacttgctaaaattttgttagtgacttttacatctacgttcgtaagaagtactgatctgtagttttcctttctcgcaatatctttttctgatttgggtatcaggtgaatgctagctccgtaaaatgatctggagggttttgtggggatttttttgtacgaaggttttgaacaagtcaacttcattcttagatgtaaggctatttataatatctatttctatttaaatgggctttggtagtttctcattaaaggaatttgtctatttcatctaagttgttacatgtattggcataaagttgttcacaatattctctcattgtccttttaatagttgtaggatttctagtgatgccttctccatcattcttgatattggcagtttatatcttctccttttctctttttttttttttttttttttacattttctgatcagtctggctagagtttagtgatcttttcaaagaatctgctttttgttttattaatttttctttgttttctttattttttctttcttttctattttattggtttcagcttttcttgttatcctttctcgtgctctctttggatttgactttctctcccatttctacttcttctgtgcagaaatgttatgcttgactggagatctttttttgtatataagcatttagtgctataaatttagcagcataccgaaatgtttataagttgggtttttttgttataactcagctcaaaatattttctagttttctttgtgatttcttccttagtcatgagttgactcatgggaagtgacttgtttgatttacagatatttggagctaatctcgatgttttatttttgttgacttctaatttcattctcctatctctctcgatgagaaaattgctatttttaaaaatcagagaaaaaaacacaagcattattttctactatcttatttttatatcttttcaaaatttacaattaatgtatatgaacttttgtctccttctttaagcttagtgtatcttagtttttctagccaaaaataaattgaaactggttcttaattccaaaataaatttaaaactgggaaatgtttctatttgttaggacataactaaatccaagacagctaatggctgaatataactgtctttattctcaatatccattttatgagattaatattttcaatattactgtcattacttacagtaaaaaaagaaggaaatttctattcacttttgccaataatcaaaacagatcattaaaattgggtttctcatacgaaagcagctactttaatagctagattaatgtccaacaattgaccacagattattctctaagactgtgctaaaatcctttttagccatttacatagtaaaactctttcctgcaaatatgcagcaaaacattggtttcaatgtttaatacatcaaagaacaaacagctactgtttgaaaatcttccatgttccgtctcccggaactttatttttggtccatggtgtttattctgatgtaatttatcatgcattattttaagcagttttttatctactgttttttataattaaaaaataaacaaaaatggattcatttatttgggtgggaaaaaatactgagaattgttccatttctttcaaagctagataacatcatctttaagcagatttgtatgcattttgtggtacaaaggatcagtttagcacatgtctgtgagaagtaaacttggccacaagagacagcaccacatacactgagtccatgaagagtggtaagattgcagattttgtaaaataatcaggattgaatgggtatgtactaagagagaccacaaacatgaacagctgaggtttgcataggataccatccacagcaggtacagttaagactgttccatacaatacatggtagtctttgctatttgggaatgatagggtttgaaaacaaggatttgaaacaggattcacagcacactaccaaatcctcagatttgaatttcctgattgcgtatatacttcaacttactgaaaacctaattcctttattccagagaaatgaaaaccaaagttcacacaagaatccctacattaatcttaatagcagctttgttaataatggccaaaaattgcaaacaacccaaatgtcctttgatgggttgatagttaaacaaatcatggtacatccatcccatagaatatcactcaacaataaacaggaatgaacaattgacagatggaccttcagggaagtatgcagagtcaaaaaagccaatcccaaaagattgcatcctgtatgattccaattatataacattcttgaaataacagaattatataaatgaggaacagattagtggttgccaagagatatggaggagatagggacagagggaagtggacgttcctgtaaaaggggatcttcgtggtgatagaagtgttcttgactatgtcaatgacaatattctggttttgatattatatacaatatcacattttggttttgcaagctgttaccattggggaaaccgctaaatggtacatggaatctctccaagttatttcttacaactacatatgaatctacaattatctcaaaataaggtttaattttaaaaaaactaattccttgcttctcccaaaattcatttctcatgtttattgttaccattaacagtaccccagtcttcttcttatctgagggtcttactgggataacgttctatcttccatcttaggacggaaggctatgcagtgagggtcgtaagatgaccacactggctgtttatcctaggcaaattagttcaatatattctgtgttgcttgcttgatttcttccttctttctaaaaaatttactttgaaaaccatgaacactgtttcactgatttagttgagatctttagagaaccattgtttaccatggtttccctggatttgaagtagtcttcggtgggtaaataactgaattttgtgagccatgctttttaaatgattttgacatgatgttttgatagattatatatttcttcatagacttctatttgattttttgttacagaactgtgccaggaagtttaagtcgtcttcactaaataccactgcagcttaggagcccccatggtgcattttatattagaaatagagtagatggtacttaggatctgagctctagatctcacctgcaactaaccctctactcctgtgtacaacagtcttcctttcatgtataaaatgaagggttttgacgatatcatctccatagtacttgtcaagattcaaatacatatgattctatgatcctagggaatttatggccagtcctgtggactgatgaccataaaaacaaaagttttcagagaaaatgtgttcagcttctgtgctatgtttgttctctatgcaaataaataaataaataaaagtttccctagaacctcacaatggacaatggatagtgaacacgaactcaactctctgttgccaagctgaaagcaaacgccagctttgggtttggagactgtcaagactggtatagaaacccaggttctctgggcttctctctgatgacagaagcctgtcatgatttaatcaaaccaagtcagaaaagggaacatagcataatgacaaaccaatataaacgtagaaatgtctgtggtatcagcccagcaaagttgtgccctgttcttcttaacattgcacagtaaggacatatgcaaagagctatgcaatttagcaacatttctgtgggttgtctgtttttaaaatgtactcattcctagaaaacaatgcagccaaattaactttgaccaaaagcatttgagatgttttccgaacatttgtggtacacaaaccaaagagtttatcataattttccagatgaagaaagagagatatacagaaattaaattacttgccctagagtaagaatataacccaataaattttgctaacatttgaagttgccagaggccatgttaattattggatacctttaaaagggccctatgacatctgattgccaaaagagatgttttctgttgaggttactttcagttgaaagtctacgaattcttttaaagacatgttttacctaaaaactgctagaaaacattggtttgttttgaggactacccttcttaagattttataaaaataataatttagtttgtaatcagctttttatataaaataatgccatgtgttatatgtcatttatccaatgctcattttctaggtgtacgttgcaggaaaaaataatcatatgtcaagttaatatcctactcctggattacaccatttaactctctgtctctctctcacacttgagatatctataagaccactctataactctatcacactttattttgttctggctctggggctggctttcccaggaagccaaagaaatatagaaaggaggaatatacaatgaccactcttccactctgatgccttcaacaagaaactatatttcttcataactggacatttaacacaacacacggcatcctagacttttttttatctgcaaaaaagaatcccatttcttgatatgacttaaagcagggattaaataacccatacacacacacacacacactcacacacacacacacacacacacgttctcacatgtgaaatagatggatgtatatatttatatatgtataagtttggttattcatctcaactcaggaacactctccactctcttctttagtgcccacgagatgagatgctataaaatagttgccctctgggctggagagcctacactagcagtttcagatccttcactgtcactgtagtcattctactgtacatcactttcaatatttttccctgtagggagtatctactcaaataaattgaaaaccactttcttctgcttctgttagtatactgtccactagtaaaacattctttacctgggccattgctaacaattaacaggacatttcatgtttcagagtgtcacaccctccgcagattgttctgcccattcataactgggaaccagaagaggagccccacaaagaggaggaggttggaccattggtggaacatatttatgaggtagccattgtctgtgttaaagttgtgttaggggtttattcttaagctctgtgcaaataaattctatgtagcattattatcattatcattattattattgagacaggatctcgctgtgtctcccaggctggagtgcagtggtgcaatcacagctcactgcagcctcgactttctgggctcaaacaatcctcccatctcagcttcctgagtagctgggactacaggtacacaccaccacacctggctaatttttgtatttttttctagagacggggttttgccatgttgcccaggctagtctcaagctcctgagctcaagtgatccacccacctgagccactcacagtgctataactacagtagatagcattttaaaggacatcaacccaagttccgagctgtatatactgcctaggttcatgctgttatgctctcatactgcagtggggtgtagtgggtgttcggttgagtaatactggatataatcacttgttccttagtaggaaagccattacatagtgaaaacactttatcttgttactattgttgttgtcattgttgtttttaattatttccatttttttaaatatttggacaacctagacataaaaatggctagcttcctagacattacttcattttttcctatatttcagatatgtttatatcttttaaactgaaggttacccactcatcttttaaactgaatgtcaccaactagaaggtaccagacagaaaacaataagaactattcattattgtgctaaaaaaaaaatatatatatacatatatataaaagcgcccgggtgtggtggctcacgcctgtaatcccagcacttcgggaggccaaggcaggcggatcatgaggtcaagagatcaagaccatcctggccaacatggtcaaaccccatccctactaaaaatacaaaaattagctgggcttggtggcgtgagcctgtagtcccagctactcgaaaggctgagggaggagaatcgcttgaacctgggaggcagaggttgcagtgagccgagatcgtgccaccgcactccagcctggcgacagagtgagactctgtctctaaaatgaaataaaagcacatataatatatgagatgggtagatggtacatagataaaaataattttacttttcatccaaagaacccaaattggaaatgaatatcttattctgagatttttaaatagttcactgattagtaaaatattttccagaagtgaaccagtgatgcataaaaaggagctgatgttcttttcccatttcaggcattaagttgtgaacagggagaggatctgttgacccatcacctgaaacatttaagcttttttcagttagaagccaacatatatggctgggcacagtggctcaagcctgtaatcccagcactttaggaagctgaggtgggagaagcacttcaggccagaagctcaagaccagcctggccaacatatagcaagggccaatctctaaaaataaaaaaataaacaaacataaataattttctaaaaagaaaccaacatatagcaaagggttagtttagtagttattcaggtttttgtttggttttgctctgtttttgcttttgtttttttttttaaataaagtcaatgctagcagtaaagagtagttattcctattcgttttcaagggaccaggcagggaattttggtaaaaccatgttccaaggcgttctgtttgaggttccttctcgattaatgccttctgttcctttcctatgtaactcatgcctctaatctagtaattctgactatgactttcatcttgagctacaagggacatgaataacatcctctaagattaacaataaagccttttcaaaagtgatgaactgtttacaaacgtagggaagatgcctcaactcctgggcagcatcagcatgaaaccctccatcatccgcccaacctgtggcccagattcaggagccttgtccaaagctggatcaaagctttgccttaagctcttttgatagcaaaaggataacacagtcaccaaggccactctgattaagaacctcactggaaaaaagaaaaaaaaaaagctgtcaaataatttaataaagctgtgtgtcctggtttctgctcaagaatggtgaaactttaaagtttgaaaatatattcagacccaatcattctcagggcagtcctgcttcaaatcttagcataaatgtggatcatgaaagtttagggtagctactggtagtgcaaaaagcaatcatcaaatattgtgtacattgctaatctcgtgactcaaaatatactatatcaatggttggccaagcttctttgataaggtgaattaaataggccatctaataagcaaaagcaattatccattgttttatagatcactgtaattttcagaactgagaaaaaaagaaaaagaagaaaatccctgctgactttaaatttttaaaacactggaataaatgtaaatgcacttagtgttttgggcaaacaattttgtgtcctccaagtataggattcacgtgttaaaaaatgttcatctctttatgagatgtggcctttcttgccttgagatctgctgatggaaacagaaggagctcagctttgaaacacgcactcgaaatgaactgtggtgatcatgggcccgccttggcacttgatggatggacattcttccagagggtgaaagagagtacatcacatatggttgcaattgacagtcagtagtcaagaaagcggaggcagatttcaatgtaaagagacagtcactaagttttgaaggcataaaatcaaaattaaaatttctagcgctatgattaaattaacataaatttaaaaccagcatcacagttatcagacaagggtagtatggtcttcaactgaggaaatccactcttagagcttcacagattgaagagttttctctaaacaccagcccatgatgctttcagagtgcttcttgccatatcgactttgaattttcttattttccatagtcatagtccagatgacttaaaaccaataatacatgctttctaaaatgggtatagagtatatggagtttgattttatctctctgccttctgctgggtcattagataacatgtcacttgtttacagctgcacaatattggaccaagtaccatcagtgacaccatcctggaggtgggctggcctttctctgcccgggatgaatttcttctctatattttccatattcaaactctgggacctctgcagtgccaaccaaatcctaatatcaatccacaggatataaaggtaggagtctggtctaatcagtggctttgttgattttatttttatggtatgaaaaaaatacaaactgggcttgtttaaaaaagaagagtgaaatcgttttaagttgcttcagtgatcattgatcagaacttttcattttatagttaaaacaccaagcctaatttaaaatatcccttctagcaaatttaaatttctttttgttttgttgcttatggtgacttgtcatttatttcacccattttaataggcaccttttatttttggctcaattagcagcacatccaaaccaaaatcataaatagacatatcacatctgggagaattagtataaaatgctatttttaaagtctttttggtctattgccaaatttcgtaaggatctttgccaaaagaggctcttccagctgcagcccatagcaagtggtgaaccgtggcaatttgccaagggccatgagaactcccagaaaggaatgttctggaccctattctttaattgaagcttaaagcctagagccgtgcttttcaaacttcctctgaatcacctggctgtctgttaaaatgcaggggctggggttggacctgagattctgcctctctgcaagcacccacctcctgtgcctgatgccagtctgtgggcctgactttcacaaacaaggagtaaggagctgatcccatccagattaacatccaaatttggctttcatgtttttctgtgaaagaaagaaattaattagcataagcccttgaaaatgccacatttgtataaagaaaaacaaaagacaacaacatcttgtagtcagatattgtccttaggagataacttcatgtaagaacgaacgttctcctagtagctaccaggacacagtgtctctattaaaaatggcgcagcgcaggcttcatggaatacccacgccaccagccaagacagagcaggtctgcccctacctcagccagtgacactgggtcattgctcattctgaaaggcattctttttcaacccaacatgcctcctattcaaagggaagactaaagggggttcattagtaaaggacttatgagacaacagcctcctcctttatgtagaaattatacataaggccacttgtgttacacaagattctttaaaatatttccttcctggaatttttttttctcatttcctctttgctcttcattgagatgattttaaattctttaaggacagtagcttattataaaataacatctgcaaatgcaaatgtataacatttaaataattaacacttttacatatcctgcattgcatttaacatgtactttcagtcatagattctttgagcacatgattctgcagagacctctaactctttttgagtgtaatgtttagtttatatctgacactatttatatatgtttgtatatattatgtaactggtttaatgtacaccatgttggttgtgagttatttgtttttttgtggcatactgtgactacgatagtattaatagatgacttgtcttaaatgttgacagattcttgcaaaccaagccatagtatatactaagcacctggtgttccctactccccacttattctcttttttttttttttttttttttttgagatggagtttcgctattgttgcccaagctggagtgcaatggcgccatctcggctcactgcaacctccacttcctgtgttcaagcaattctcctgcctcagcctcccaagtagctgggattacaggcgtgtaccaccacgtctgactaatttttttgtatttttagtagaaacggggtttcaccatgttagccaggctggtctcgaactcctgacctcaggtgatccgcccacctcggcctcccaaagtgctgggattacaggcgtgagccactgcgccccgcccccacttattctttaatgtatgtgcttggagtaaaattctgtctgaggctaatacttttaaaaatgcaattcaattatgttcattttcctaaaactttcaatctgtggaaattgaatataagatttaaatacaatataaagtaatatctcccttaaataactaatcatagcaatttgtgaatttttgaaattctaaattcatagagaagttgaaatgttattactttcaggttctcaaagtactgtcacctatacttaataaatgctccagagagtctaaaggagcttttattaatagacattaaaaaacagataatcaagagagtttacattagtgactataaataattgagagtactggaaattattctcctcttatgatgctaaataattttttggtgaagttgctattaacttacatggcaatttaatttttcctagagaatgcaaacgtcatcttttcttgatatgacttggactttagtgaaaaacaaataatctcttacctgttgttgtcttcaacagaatagatctgagaaatttttaattttaataaccattttaaattcaaattagcatgaaaatgaattgctgttaaaaaaacaaaactgtgccatagccaggcacagcgatgtttgtagctactcggaaggctgaggtgggaggatcacgtaaggccaggagtttgaggtcagcctgggcaacatagcaagacttcatctctttaaaaaaattgtatagttagttttatttttagtaagaagcagacagaggatgggcttactaaaaggaacagggaggcagcagaaataacatttgtcaaggcaagaattcaattccagtatccaatcttactcaccggggaagtgaactaagcttcaattcctgattatttggttctacagtttctttacaagaagagtgatctagatagtaagtgcctcataaaacagctgcatctgtgagtagttcatgtctacacattcttcaccctttctgaggatgctccagtccccactggactagcccccaaaatgtcccaggccaccgtgggcctgtaagagaggcgctctctccccagctttctaaagctgagggattggccatttccttcctacgttttcctctttaatcattccattgattttctttcagcaaaatccctttccctcgtgttcagatacactttgtagtcaacgtcccctttccttatgtgttcttaagttgcccacttcccactggaaaaatgctctcttcttcgttacctctccctgatccccacagatctctaggaaaacttgtgaaaaataagccagacttcctaagaagcattttagaggtcacacactccagggatccattgccactaactctaaagccttcacaacttcccaaatatgccctgagaatccctgcaagttcccacatacttcctaatttttctcagttaaatcgatttccacctaatgtaatgtgctgaatgtaatgtacttaacaaatggattttcttctattttttaaattactcatatggcagcagtcctggacattgttattttccttacaaatacatactttgacggcatcaaagccctattgaggattaagttgggtttttgtggactggcttgagaactgaaacaccatttaaaacatcatttctaaagagaaatgcattctgaatgccaaacatctagcctaaaaccttctgaaatacaaccggtctataacctggatatgcactccaaatacaacataactctgaaagtcttctcacataagtctcagcatctgataagacccaaacaaggttcaggtattttttatcacagtagaaactggttatagtttggttatctcagcaagctaccctaatgtccccaaagtttcaggaggagacactgactgcttttataagctaccactgggatcatcctgtaacctgtggctgtttaaaaaacagtggtgaaaagttctcatccacaaccatctcacttgttgcccaaacacagagcattagcaactaaattgggatggggcaggggcagacacacacaaatgcttctagaagtcagtgagttcttattctgaatatttgtcttggaccaggagcatggctcgtgcctatgatcccaactctttgggaagctgaagtgggaggatcacttgaggccaggagtttgagagcagcctggacaacatagcaagaccccatttctacaaaaaataaaaataaattagccaggcatgatgacacatgcctgtagtccctggagtcccagctgctcaggagactgagaaaggagaattacttgaacccagaagttggaggctgcagtgagctatgatcacactactgtactccagcttgggcaacagcatgacatcctgcctctaaacaaataaataaataaatacttgcctcatatcagggtttatgggattcactcagcttggtttgttgacactttcaacccttagggcgtgagggaaggtggaatcaagggtgggcaacagcctgggggctgcaggagatcaggaagggctgggtgagctgcacaactggtgtttcccctgtgaattgtccccagggcccaactgaggtcagcctaggggcatggaagtgccttgaggatgtcccttcccactttctcttttgcctcccaatgaaaatgtctctgcctttgagttcctgtttctccggtgatagtttctgcttcatcaggttcagttgtgttttctgtaagtttaggggcataagcagatgcccgggaagggtctccctccaggcttcagggtctaggtcagagatagaggattttaacatggcaccttattcacatcgtaccatctacaacattttgaaatgttcaactgtctgcagcatccaaagcaatccattagagctaatttttttccagatccttcttggaataaaattttagagttgagtgaagtatttctcaactaatctaaagccagtacaataattatttcaaactatcaattttcttatttgatgggctttatcctagggtttggagagtcctgcacacagactgttatctttagataagatgaggttgaaaaagtaaaacctattgaggagccaaaagtttcataatgagtaaaggatttttctttttctatttttttcttctttttttttttgagatggggtcttactctgtcagtcagtctagagttcagtggtgaaatctcagctcactgcaacctttgacccctgggttcaggtcattctcctgcctcaacctcctgagtagctaggattggcacccgccaccacacctggatagtttttgtatttttagtagagatgggttttcaccatgttggccaggctggtctcgaacccttgacctcaggtgatctgccctcctcagaggccgggtgcagtggctcactcctgtaatcccagcactcctcagcctcccagagtgctgggattacaggagtgagccactgcacccggcctctttttttttctttttttaagacaaggtctcactctgttgcatgggctggagtgcagtggcactatctctgctcactgcaacaacctgtctcccaggctcaagcaatcctcccatttcagtctcccaagtagctgggactacaggaatgtaccacccaccttgctgatttttgtatttatttgtagagatgcggtttcaccatgttgccaaggctggtctcaaactcctgagctcaggcaattcacccacctcgacctcccaaagtgctgggattacaggcatgagccaccatgcccggcctaggatttttctttaattggcaagattttgtaatagacagctaagtgtgagatgcagagggaaaaggcttagatgtgaaaccgtacctaggagaggaagaccgataagatgcccacatataacctatgttaagactatggaacaccatttggggcccaagttcaggaaaataatcctgagataaaagtggcctgaaagactctatagactaagaagggcttaacatgagagaaagctgatgctgtttgtaaaaactgctgtgagagccgtggaaagctggaggttgccgccgagaatgtctcctgaaccagaccagtcccatgggaagtccaaattacaaccagatagtacaaacatggaaagcggagacacagaaaccgtccgttctttaggaatgagagttttagagttatgttttagaatgagtgggcccgcagacagtggcttggcaaatttgcatagttttgtcttatcctttagggtactttcttcttcctaactgccttcgtgtactggttttccttaattcagaatgcaggcgctcgttacttcctagcacaacagttcttgacctctttccctctgtctctcactcacgcgtgcgcacacacacacatacccttaaaaatcaagacatatggctaggcacagtggctcatgcctgtaatcccagcactttgggaggccaaggcaggaggatcacttgaagtcaggagttcaaaaccagcctggcaaccatggcaaaaccccatctctgctaaaagtacaaaaattagctgggcgtggtggtgggtgcctgcaatcccagctactcaggaggctgaggcaggagaatcgcttgaacccgggagacagaggttgcagagagctgagatcacgtcactacactccagtctgagtaacagagcaagactctgtctcaaaaaaaaaaaaaaaaaaaaaaaaaaaaaaaaaatcaggacatgaaaggaagaagattatttagtatatctttaccattaactcctgatttctttgtggaatcattttgacagccttgaccacaggaaccgtaatttatgtcctagctgaagcattatttgatggctgttacttgccccttcaatactcggctgtcttctataaactctcctcccagaaaaaaacagaacaaaacaaaacaaaacaaaaaagaacttagctgtttattattttagaaggtctgatcaggaaaacagtagtcaattttaatttacttcctctccaattgtgacgtactagtgacatctatggcttgcccctggacctggtcagtctgtcctaggtatgcttcctctttcttatgggaatgctacctgtgatagaagaattgtatttgcctttttaagagtgcctgaagatccaattctcgaccatcaaaaagaattacacagtctgagatttttaccttctctttgagatggtcttcaggtttgcacatatattttggaatgtaaaaacaccatgttcaaatactaagaaagcatcaacatcaccagtggagtgagtagattcttttagttgtgctttgcatgaacttttcaggaggttaaaaaagtgggggttttctttccctacaaatcctcaacattcatgtcttaaagaaaattacatggtggactgccccccagggcttgtctccacttcggtttaattataggcaaagtacatgagagttgtctgttgtttcttgtgtgctaggaatacctgaaatccaaaaacaaattacaaacaagaaaaagatagtgtgcattgcttttgtttgggttcacagggcccttcatctaatttcacccaactccttttttcaaatgccacatttccgactgtactgcacatcctggctgcacagtatccctttaatccataaatttaaacctatgacacagtgaagagtttggtaaagaatgatgaaaatagaaaattcctgttgggctaaattctgagtagcagctgtaaaaagaaacatgtttaccaacaattatttccttattgcagaaagaagtcattttcatttgttctacagaagacactttagtggtgaccaccagcttctcctagcacttaatgaattgtcctgggaactgtctgcctatcatggatgctaagaggccagcgtcctccaccctcagtggaaaaccatggcctgtaggttcactgtcaattgtgaaagaggctccaaatgttcatgtagaaaatgggctttaactgttgtttagatttcttgggtagcttcttcctttttgttttgttttgtttttaaataatttctggaatgtcatttcagaaagctggtttgcaagctatttggagatcttttgactatggtgtttaagagtggcattcctctatttgtaaaactgtgtcacaaaagaaagagatgtgttccatcaacccctgccacgtgacactgtcattctgtagctcaaagtaagccctgtgttttattgagagaccacttaaaatgtttgtgaatgacaatttaccccaataggacatgttctttatttgtacacaagatacatctgatgaaaccacaccggaagttaaagagttttctttggggtattggtttttgttttttttttttttggagacagcctcactctgtcacccaggctgctagagtgcagtggcactatcttggctcatggcagcctctgcctccgaggttcaagcacctctcctgcctcagcatcctgagtagctgggattacaggtgtgcaccaccaccagcctggctaatttttgtatttttggtagaaatggggttttgccatgttggccaggctggtctcgaactcctggcctcaagtgatctgcctgcctcggcctcccaaagtgctgggattaccggcgtgagccaccgcacctggctgtttgggctattgttttagcaccaccactactattactgcttactgctaataataataataataggctatatcttgggaataaagagtcagtcccttgttttttatagtgcctcttctctgtagcttggttaaccacagagttaacctctgtaacataattgtcaatgacctataaaaaatttacatgattcatctcaaagcaaaatctacatgtacacccacatagtatatgatagaaaacatatgagagaattttagctagtgatttccacaattcttaattttctgtctaagctcactttttatctgataccatcaaaactgttctatcagatcctccatcactgggcatctgtattaggccattcttgcctggctagaaatacataacactgggtaattcacaaagaaaagaggtttaattggctcacggttctgcaggctgtacaagaagcatggagctggcaactgcttggcttctgggaggcctgaaggagcttttactcatagcagaagacagagtggggagcaggcacttcacatggtgaaagcagaaccaagagagagagggtgggtgggcagggagtgccacacacttttaaacaactagatctcatatgaactcagagtggaagctcacttagcgccaatgggatggcccaagccattcatgagggatccacccccgtgaccccagcatctcccaccaggccccacctcccacattgggaattaaaactcgacatgagatttgggaggacaaatatccaaaccataacagcatcctcgatcaactgtggggcttcccctcctcctcattgtgccaggctctgccatggttctgggatgtcccagggcccacagtgctgggctatccaaggcctaccctccggtccatgcactccacctcccagggtttctgccactggtcaacaacacctcaagctaccctgcctccaagacattcgactcaactttcctttctcctccaattcaatctcctgtttttatgatggtctcacttgttctcttcaagaaaatttttcttccctggtataaatgctttctctgacacagttaccccatcccactctcaggacttcctctggccataccttctttcctgccaagcctggactccatgatgagttacttgaaacacgcttttacaagcccccataacctcctgtttctaatatccttccaagcccctgccctgaaaatctcagtcatgcacagtcccacagcctggcttctctaccccatagcctgatggcgccatgacagattgatgtcggggcgcacgttcacggagccgccagcttcgcaggggcatctgccattgtgatgatagcaccctcctcgttgccttgtctaaaccttcaccactctctctgtccttcctacgcaatagctctatcattactattaggaatgatccatttccccatcccaaacccctccccacctgatagggttaggctttgtgcccccacacaaatctcatcttgaattataatccccataatccgcatgtgtcaagagagagaccaggtggaggtaattggatcacgggggtggtttcagccatgcttttctcgtgatagtgagtgagttctcacgagatttgatgtttttataagtgtctggtatttcctctcctgttcattctccctcctgccaccttgtgaagaaggtaccttgctcccccttcaccttctgccatgattgtaagtttcctgaggcctccccagccagggagaactgtgagtcaattaaacctctttcctttataaattacccagtcttggacagttctttataggggtgtgtgaatggactaatacaccaccccacccttccacatgcccctaatcatctctcttccatcctcaattgctttctaacacttccagagaaaggaggattattcctccagctccatgaattaactttggtacatcaagtatctccatttcccgtatcttcaacttcttcctctctccttggacattccttgggttctataaactttgttaaatttctcccatcttcaaaacaaacagtaagtgcagtaatttgactctgtattctcttccaagaacggacctctttccccttccatttatagccaagctgtgcttgctatctctactttttcatttctcatttactttttttacaattttacatttttgtacattgttcatgatttttatgttaagaacgctaaatgctatcataagaatatatcaagcaacatgtaaaaacataaagaagagcattttaaataatagtgttaccacctgtttactgttatttttccatttatttatgcattaacttatttttccacatccataaacattttacatacatatatatatatatatatacatatatatatatatatatatatatagccaacagataaggagacttggccaggcacagtgacttacacctgtaatctcaatgttttgggaggctgaggcaggaggatcacttgagcccaggtgttcaggaccagccttggcaacatagcaagatgctgtctttacaaaaatgaaattcagcaggtgcagcaggatgtgcctgtagtcctagctatttgggaggctaaagcaggaggatcactctgctgtaatgagctgcgattgtacccattatgctccagcctgaccgacagagtgagaccgtgtctataaaaatgaaaaataaataaataaggagacccttttaaaatctacaacattattatcatacctaaaaagaaataagcaaaacttccttaatatcatcggatctccactactctaacactttgaggactgcccttccagattatttctatttatagatctacaatgtcagatacatccatttttattaaaaatacaatcttactacatttgctgttgtaaacctgtcttttccccttactaatatcttgtatctttctaaattccaatggagcttcatgccatcatttttaaaacctgtccagtagtattctgtataaatagatcataacttatttaatcagtaacctgtatatgcctacaaagtgttaagctacagtttttcttctctattataaatagtgttgctacaaacatcaatatttgttttcatgccttatttgggggacaaggctcatcttgtctctcagccgtagggaatttactataagaacaacagaaggatttaatttcatatctttttaaataattatccatttgttaaaatcctttcactcttgagctactgcagttaaatttccacctccaccaatctgtcctcataaaaggacatctgtaattttgttctttttttctttttattttttttagaagcagggcctcactctgttgcccaggctgagaattcagtggcatgatcgtagctcactgcagtcttgaactcctgggcttagatgatcctcctgcttcagcctcccaagtatctgggactacaggcttgtcccaccacattggctattttttttttaattagcaatgaggtatcactatgttgcccagtctggtctcaaacacctggcctcaagtcaagatcctcctgactcggcctcccaaagtggtgagattacaggcataagcctggctcataatatctttttaaatttaattttaagttttggggtacctgtgaaggatgtgcacgtttattacataggtaaacatgtgccatggtggtttgctgcacctgtcaacccattacctaggtattaagcccaacatgcattagctatttttcctcatgttctccctccccccgcccccctaccctgacaggccccagtgtgtgatgtacccctccctgtgtccatgtgttctcattgttcaactcccacttataagtgagaacatgcagtgtttggtttttctgttcctatgttagtttgctgaggataatggcttccagttccatccacgtccctacaaaggacatgacaaaattgccaagttcagtgcataaaggtcttcacccttccttacttctctgcaggatttggcattctttgtcactctcttatttttgcagctttcttttccttgggcttgtataaaaacgacactttcctagattacctcctacatctgatctccctgccttagctttcctctccagattatcttcatctctctgtttcctgggaggctctaagtgactctctgctttgtgttttccattttctcatctggcaatgcagaccagctggcaggcagcttaggtacagctggataggcacagatgggccccagaccaagcatgcagaacatcagaggcttggcgagtgtacctggggccatcgggaacgaagagcaggttagcatgctggagtgaaggaccttgggttcttggtcagagaagaggctggagaaaccggccaaggccagcatgtgaggacctgtgtgtgccatgctagggagtctggactccgtccttctgtttgtctagtaggtttttccaggttttcatgacatactgagcactctcatttcatcttttgtgatgcagcctacatcggccatgtagaaatttcttttcttcattccatagagatgggcatactattattgctcctgtgactacaaagagaaactgtgtgaaagaaatcataattctcaagggtgggagtggggaacagaaaattaggtctttgtattcagtgggtctaaaataaagaatgttaatgcgatattctgtgtgatttattggaattctcaaaatatttatccagccagcagatggacccagcatggaacctgagataaaatagtaagttctaggacatttgcaaaacgaactcagggctgaaaacagactccactgcagcacagtgaacatgtagcagactttcgaaaagtcatttttgtcagggcagaattttctcctaaaggagtgcaggaacgtggggttcagccatgtggatgtggggtctttgaccacatcaggctgtttccccaaatgaggttggcacctcactattctgtcacctcaggattcatctccccatacagaacgttcctcagtttaactggccccactctacaatgagaggaaagtaatgagagaaggatggctcatgtctgaaacgtcacttgcatgttttctatccttgtggggaaatgacttctgcttcaaatcttctccttgcaagataaacttcccaggaatgcattccccatgcttcgtgaattcctgtcattgaagagtggaaaagcttgttccttgtgcgtgcaggtcatgtcactgttaaacacactgctggtaatcacaggtctggatcctcatgtgaatcatattccactgagaaaaaaaaattgcctagagttcaaggctaaagaaaatgtagcaactgttcatgtgtttttaatgtggtatctcccactttctttttgcagcctgctgcctccccagaggacacccctgagctcagcgcctttttgcgaaactctactattcctcatcttgtcaggaagagggatgtacatgtggtcgaattccacagacagagccctgcaaaaatactggtgagttatcccagtgtgcatagaactgagggaaatgagtggcttggatagaaccctcaaatacagatagttttaacttcaaggattgttcttggtctccttcagtgctcagatattcctaacgtttggcagtgtttatctcgagaatgaaaagcaacttttctgtaagaattaaggagcacttgcaatataaccttttcacttttctaaagctgccatggaggccactttggagaataatggtgaaaacatcaactgtgaccttcaatccatttcaggaacatacactttcagttgttagtccgtgcatagatgctgggctgtggtagtttgaagtgagcatggacccttggagttctgcacctgtcccagaatctcagagcttctgcttatctggaagaggcaagaatggtgtgttcagggctgggtatggtggctcacacctgtaatcccagcactttgggaggccaaggtgggaggatcccttgaggccaagggtttgggaccagcctgggcaacatagcaagacccagcctctactttttaaaaaaagaatgctgtgttcaggtttcctgggccaaaacccctgctgagtcttagcattggggtctgtggcagctcaagcctgagcttagttagcccttagcaatactatcttcagtgttcatgagtcagcactttttttgtttgttcggagacagagttttgctctgtcactcaggctggagtgcagtggtgcaatctcagctcactgcaacctctgcttctcgggttcaagcaatcctcctgcctcagtctcccgagtagctggggctacaggcacatgccaccatgcccagctaatttttgcatttttgtagaggtaaggtttcactatgttggccaggctggtcttgaactcctgacctcaagtgatctgcctgcctcatcttcccaaagtgctgggagtataggcatgagccaccatgcccggtcagagtcagcatttttgattctattctcccactcatcctattgcggcagcttctagtgctttatgttttcatgtgaatattcatcctcttccctgaccatgtggcaagggctcaaagtgaatgtcagggtttatctgtgctctgtagaccatgtccataaaaagtaggaagctgcatgcacattctccagctatgcagaagtaatcagagatcacctcagaagctaatacccttctcaaaagcaagcaaacaagagaagtggggatggtgaacaggtacaaaatatagttagatagaatgaataagatctattgtttgatagcacaacagagtggctatagtcaacaatttattgtacatttaaaaataactaaaagagcataattggaacattttgtaatgcaaagaaatgaatgcttgaggtgctggtacctcatttaccctgatgtgatcattacacattgtatgcccatatcaaaatatctcatagaccctataaatatatacacctattacataaccataaaaattacaatagatatataaaataaggataaagcaagaaaacaaacattccgtgcttggggcagggacaggctgggaacactgggtctggtatggggggcacagaccaagcacgtacttcctgccccatagctgcagttcagaagctcagtccaagatgcagtgatttgtggtgacactgaatcaaaggccacagtgacaagtccagggttatccatccaaagcagcaagccaaagagagagacctggctgggtatggtggctcagcctataatcccggcgctttgggaggctgaggtgggcagatcacctgaggtcaggagttccacaccagcctggccaacatggtgaaacccatctctactaaaaatacaaaaaaaattatctgggcgtggtggcaggcgcctgtaatcccagctactcaggagactgaggcaggagaatcgcttgaactagggaggtggaggttgcagtgagtcgagatcgtgccactgcactccagcctgggagacagagtgagacttggtctcaaaaaaaaaaaaaaaaaaaaaaaaaagagagagagagaccctggcagaagaccgcagggcaaatgagtaataagaaagggaaggtgttgggaggccgaggtgggcagatcacgaggtcaggagatcaagaccattctggttagcgtggtgaaaccccgtctctactaaaaatacaaaaaaaattatccgggcgtggtggtgggtgcctgtagtcccagctcctcgggaggctgaggcaggagaatggcgtgaacccgggaggcggagcttgcagtgagccgagatcgcgccactgcactccagcctgggcaacagagcgagactccgtctcaaaaaaaaaaaagggaaggtggaggtagaagtggaagagactgaaccaaggagggtgctagagttctttctacaggggcagcagtcacagtcctggctgggttgaaagccattagacacctaacctacctatgctgctgaccctctccagactgggttcatcccggaaactgtgaatggctcctagacttgttgaggtgccacggtgcactgacccaagggggcatcctccctccttccctgtccgcagtcctgacagcccattagggtaggtggcatgttttttttctcagtgttgttttctcaacatgtagcataataccagctcatctgttgaacaaacatgtgaatgacacagtgagtgaactcatcacagacagtattaatagcttttggaatcattgtctaaaatgctccatggtgtgcccttctatgtgttcttaacctacatgctcttaatcctaaatccaattataagccaatgatatattgcaagccgtttaaaagatagtgttggtagtgaccaaattcattagccaccagatctgctgaattcaagataaaatgttatgacatgaataaatgaaatcagccattttttatgacaatgttcaaggatgctttggggactagaactgctccagccatttatgaaactgaaataattcacggtagctatcactgaagaaaggaaatcagtgctcaagaaattgaatccctgattttctcatctgtagaacggaaatccatacgcttgatttacataactgaaaaattaaagtttaagaaaggatttgcaattccccctttgctttctctctccctctctgccttgcaaaaaaggtttttgcttttccttcaccctttccccatgcttgtaagtttcctgaggcctcccagtcatgcttcctgtacagcctgtggaactgtgagtcaattaaacctcttttcttcattaaaaaaaaaagaaagaaagaaagaaagaaagaaagaaaggatttgcaaagataaaatgtaatgacagtaggagggaatgttaacaatcagttgacccttcaactaaagtggaaaatgcactgggtataaatagtcttctactctctcagccaatttagtggcatctgtgggacctgggtgcatgtgcatatgtgcaagtgtgtgggtgcacacatggtggggaggacagacacagagttccaatacaggagacaagactcaggaaggatgatgcaaggggtggatctgggcagccctgaggcagccatgagaccatggcttcatgccagagaggcactagcccaaaagaatagtgcattattttttgtaatccatagacttagggtacaaggagccagatgaacagcccctccccccataggctctgcctctcctgcagttctgaactcagggcaattcatcagggggtcccggtcggagttatcagatgatacagagaaggctcatgagtttttaaggaaaacaaatgggtggcaagcagggagctgcggaagtcctaaattaacttcctttccattcctgcactcctgtatttacctggaattaactatttttaaaaaacaaaagcatgacaaaatattttaaaactctgataataatttatttcagtccaataaagtaggataacgccatattaaattaatcatattcctgaaaatcccaaatgtgttacccatcatatggataactttttttttttcttgagacaagagtttcactcttggtgctcaggccagagtgcaatggtgccgtctcagctcactgcaacctccgcctcctgggttcaagtgattctcctgcctcagcctcctgagtagctgggattacaggtgcgtgccaccacacctggctaattttttgtaaagacagggtttcagcatgttggccaggctggtctcaaactcctgacctcagctgatccacctgcctcagcctcccaaagtgctgggattacaggtgtgagccaccatgcccagctggataactttttttagtcatagccaagagccctcaaagaggatattaggataaaagacatgtaaacaaatcctagttctgtgtctcatcgatgcagaagttttcaagagttttactttgggatgatgaaaaagctttggagttggatggaggtgatggtggtacaacattgtgaacgtacttaatgccaccaaactgcacactttaaaatggttaaaatggctttaaaaggtgtgccttaaacactccttgacattcatttatttcatcttgacagtagaaaatgtttgaactatggaaatggacagaaaaatataatgagcaaatctcaatcagttaaacttaagtcaaatgaagcatttgttatgatagaagtagctgaagttactttttgaagacaaaaaaaaaaaaaaaaaactatggcaactggaagattgtaattcaagtaaattttttttttcttgagatagagtctcgttctgtcgcccaggctggagtgcggtggtgcaatctcagcttactgtaacctcggcctcccggattcaagtgatcctcccacctcagtctcctgagtagctggaactacaggtgcccaccaccatgcccggctaatttttgtgtttttggaagagatggggtttcaccacattggccacgctggtctcaaactcctgacctcaagtgaacgtcccacctcgtcctcccaaagtgctggggttataggtgtgagccaccgcacccagcctcaagtaaatttttatgacactgtaatgtttaagaaacataacagtagggaatccatatactattccttttaggataaattaataaagctctgcatgttatcatttttaaaaagcttccatggtgtacaatagaacagaaaacaattgatatcattctcagcaaactaacacggagaacagaaaaccaaacactgcatgttcccactcataagtgggagttgaacagtgagaacacatggacacagggaggggaacatcacacaccggggcctgcccgggggtgaggggataggggagggataacattaggaggaatatctaatgtagatgacgggttgataggtgcagcaaaccaccatggcacatgtatacctatgtaacaaacctgcacattctgtacatgtatcccagaatttaaagtataataaaaaagagacatctacagaattctaatatgcagtaccaatgggaaaaatccctctgaaaaaccaatgtccaaacatatgcagtattaatgatttgaaaaatcaaagttagacagggtgtagtgtctcatgcttgtaatcccagcactgtgggaggccgaggcgggtggatcacgaggtcaggagatttgagaccatcctggctaacatggtgaaaccccgtctctactaaaaatacaaaagaaaaagccaggcctggtggcggacgcctgtagtcccagctactccagaggctgaggcaggagaatggcgtgaacccgggaggcggagcttgtagtgcgctgagatggcaccactgcactccagcctgggagacggagcgagactctgtctcaaaaaaaaaaagaaagaaaaatcaaagttcaagtatgttttttaatttccacttcagggtatgtctcattagtacactgagacagtcgagatcaataacgaaattttttttgaaaattgtatgtatttgcgttgcagggtccatttttttccttctattgtttctctttaaatgttgatgtaagataattttaaacttccgaatatcataaaaactctcagatgaaggccaaggcagttcttgatttccatatctggttttgttaacacatatattactctctttctctcttactggttcaaaaattgcaaatcttatgaccccctatgtcctggagtcaaaacaactctggatagaaagtgattatgcgaagtttattctaaaatcaaaagcgaaataagacctcctacgttttttgtttagttaaaaacaacttactgaatcccatttctgatgaggaatttgaaagtgcaaaatgccaacatcctgtgttgggatcaaaatttccaatttgcacaggaaaaatttgtatctaaaacactgaaaaataatttctcctccgcctaagaatacccttccctttctcatagtgggcccctgctatttctgtagctatcacctccatctcctcctctccaaactttcctgtcttctgtttcattgcccagcttccagccaccttgcctttcttgatgcctctccagcatttgatactattggccacttcttgaaactatcacatttctgaaattcccccgaaaacatcccctcctggttctctttctgccatttggatggtctcttcttagaaattctcatctaagatttctctctgcccatcctttcaatgcccctgttccccaggattccatcccagccccctcctcttctctctcatccatttaattttttgcatgatcatatttccagtaattcctaagtgcctcctgtcatctcagccctcccttactgaattcaagccttaaaggcatgatctgggtgtctgagagccacgcccgtcctcgcatacccaaaacccttgtctccatgacttctcaaatgtacctcctctctagaatccccagtctcagtgttaccagcacccatccaccccattcttctccaaagagcattctccatgtaacctctgtgtagtcatcatgtctctattctatttcctaaacttctccaaaatttatcttcctctctccatttccactgcctcagttcagggcctcagcatcactcaccaggggctcttgcaacgggcccctatcaccctcctgccccccaatcttccctctctcttctctttcctctcatattacccatccctctaaaatacaaacctgatcaatatcccctggatataaaagcatcacaggttctccagtgccttctgaataaaatctaaactccttagcatgcataggaagactcttcatatagactttctctcattgctatcctacttccatctgtccatttcaccctcatataccctgctcttccctttctcaagcatgccctggtctagtacaacagaatcgtgggccaggtctcccattctgctaggtgacctcccattcataccttcatggctcattccaaacattgtcttctccagaatcctctagcagagctggctatctgggttccccatctgcaaggagtctacaactcctgaccttgacacccctcttccctctgaagggcagggttagtggtacacagcatgtcagccgtgaagcacaggtcaacatgagagtccttgaaagggccacaaaccacagagttttgagaattcctgttcctgctgtgggtacctgtattggtccattttcacgctgctgataaagacatacccgagactgggttatttataaagaaaaagaggcttaatgggctcacgattccacatggctagggagtcctcacaatcatggtgaaaggcagaaggcacatcttacatggtggcaggcaagcagagaatgagagccaagcgaaagaggaaaccccttataaagccatcagatctcgtgagacttattcactgccatgagaacagtatgtgggaaaccgtccccatgatccagttatccctcaccaggtcccacccacaacatgtgggagtcatggaagctacaattcaagatgagatttgggtggggacatagccaaacaacatcagcacctcagcacccaactctagtagcccaaggacagtccacccacgtgcctttggaagcatcctgtaggaaatgaacttcaccgcaatttatcagacaatatattactaacccctttgcagagaattctgaggatcttgaaaaatgttctcgaaaaaggttcttgtcgtaatatgttccttggattattctgtgttatatcaatttcattaaagtgaaatgtctcagtcaactacttcacataatatccaatacattgatttttattgagtactcacaggccaatgttgagggcttgagatatgaaaaatgaatacgcatgggccacaagataaatttaaacccatgatggagtacaattagagaagtatcattctgtgcatggcacacaaaaaatggattatgatgtgttcatttatttccatgctggaatctgattagaaaatctgatttgaggccaggcatggtggttcatgcctgtaatcccaacaccttgggaggccgaggcgggtggatcacctgaggtcaggagtgcgagaccagcctggccaacatggtgaaaccccatctctactaaaaatacaaaaattagccaggcatgatggcgggtgcctataatcccagctactcaggaggctgaggcaagagaatcacttgaacccagaaagcagaggttgcagtgagctgaggtcacaccattgcactccagcctgggcaagaagagcaaaactctgtctcaaaaaaaaaaaaaaaaaaaaaaaaaacagaaaagaaaagaaaaaagaaagaaaatctgatttgatagatagaatgtcattataatgaatccttttgaggaacacacatttcatatattaaaggttattcattatacgctgggcaattctagaaacctattaaaaaatagcctaatgaatgaaagtcacagaaaagcctcctttataaccaggaaataatttagacagaagaacgttatggaacaaatgtatgtcaatcggtcagtaactgtagatctttgagataatataggctcaagagtcttcctctgcaaccccttccagacttgctgaacccagcactgggtattgtgaatatctataagcaatgccttccccagttctgagaaaatgaaacagaacaattaaattgctgctgcagaaagattctcttaaagtcgttcgaaaagagcttaaattttatgttgcattttgtgttccattcatcctcgccattaaactgtgttttcttggttgttgcaatatattgttctttatttacattaataatttatcataaggtgatgacttttgaggaaatgaaatgtaaataagctaacttcagtgttcagtctctaccatgatttaaagactctgacgtgttcccactgctgtttgcagaattgtacaaatatcgagtgtttacaaatctcctgtgcagtgggacgactcgaaggaggagaaagcgcagtcctgaaagtcaggtcacgattatgggcccacaccttcctccaggtaataaacaaccacagaagcacatacacactgctcactgggagctgcttcacaaaagctcagtgggaagtcttttcatagagatttctaatttaacactgtggaagtccgaggcagatggattacttgaggccaggagctcgagacaagcctggcctacatggtaaaaaacccatctctactaaaaatagaaaaattagctggtcttggtggtgaacaccagtggtcccagctacttgggagactgaggcatgagaatcccttgaacccaggagatagaggttgcagtgagccaagattgtgccactgcactccagcctgggtgacagagtgagacactgcctcaaaaaaaaaaattaaaacttgaattttaaacttaaaaaaattttttttacatttttcaatgtaaaagtttcaaatttaaaaaattacttcaaataaaatgtatgtggaggagttgaacaagatgaactggtcatttttcccagcaggtaaagacagtttaaacatcctgagtccctaagaccttgagaatagatcagaaaatgtacttagtccactgttatatacccagtgttgggcacagtaactattagtcagtggcagcatgatgagtatgagaacataatccaagatatatatgtccagagaagttaaaatagaaatcaatttagaagggaaaggggagattgttctagaaggttcctcttgtcaagtggtcctgcagcatgggctccaaccaggacagcacctcagccaagttccaggtacgtgagtatgatttacagattatgcaccactcctgtggttggctctgcatcccacaatagccagggatcattccattgatttgtgcacttttttttgttgttgttgcttttctgagatggagtcttgctctgttacccagcctggagtgcagtagtgcgatcttgactcactgcaacctctgcctcctgggttcaagcaattctcctgcctcagcctcccaagtagctgggactacaggcgtgggccaccatgcccagctaatttttgtatttttagtagagatggggttttgccacattggccaggctggtctcaaactcctggcctcgactgatccacgtgcttcagtctcccaaagtgctgggattacaagcatgagccattgctcctggccgactatgggcattttaaaagtttaaaatctcttttatgctaagaaaatgagagtttcattttggaaagcgctatttaaatgatactgctgtgttacaaccttattgtttggggaggaattttttttttaatcctaaattaactcttaccacgtctacacattcttgctcacattttaactactaaacaaactcatttggtttattgtgccatgaaaaatcaaagggtcaaatccctttgagtctagttataaatatagaatttttttatccctagatttttatgttttctatgatttaatatgcttctacagtctcgtcaatcttatttttgtttttaaaataaaaacgagggaaattaaagttttgttttaaaggtcattgtgaagccatcttcctttcttcctttcccttcccttcccttcatttcccttcccctcatttcccttccctttccttccctccctttcttcccttccttctttcctttctttattttttcattgctttttctgtgtctcttttctttctctctcttttcttccttttctttctttcatcttccttccttcctttcttactttattttctttctttccttcctttccttcctttctcctaaggcagagtttctcaatctctgcactattaacgttttagaccagatcgcgctgtgttgctgggagccaccctgggcattataggatacttagcagcacccctgacctctacctagtaggtgctggtagcaccctcaccccaggtgtgacaaccaaaattctctccagatattgccaatgtcctcaggggacaacatcatcccattttgaaccactgacctaaggagaagtacagtgcccaatttatttgactttttaaaaaatcaaacctttacatattcattcactcaacaaatatgtagggaggacctactgtgtgccaagggctgcttcagggtctagttataggagaaatagctgtgaacacaacagacatagcacctgccttcacagggctgttatctcagtggagggaatcagaaactgagcaggcaaacagatgcatcagtgccgggaagaaagtagaatggtgtagggagatcagggcagtgggataaatagtagggagtgcggctgcttctgcaggtaggatgggcacaggagaggcctaggaggaggtgccatggaactgagacctgagtcacgcaaagacctgtaggcagagccccagacagaatacaacgagctgtgcaaaggccctgaggccagaacactttagacatgtttgaggaacaaatggagaccagtgtgtcagtatcaccactgatgagacagaaattacaggaattacataccatggatgggagcctgattttagcctaagtgcaatggaccactacaaaattaacctaaggagtgatgtgataataattacgttttttaaagaacacaagtaaataaataaattaatacatactctaacaaagcaatactacacagtaataaaaaggaatgaattagacacattggcatggatgaatctcaggcacacaatactgaattttaaagtcaattatgattccatttataaaaagctaaaaaaaaaaacaggcaaactaagcagtaggttggtaaaactttaaaggaaaacaaggaaatgaaagtacaaattcaggagagtagtagcctcttagggtagaagacatttagcaagaaacgaagagaatgtttcaaaggtacttgtaatggttcattaaagtcagcggtaggcatgtggatattcatcttggcttctttatcatcatgtgttataaatgatttatgtttactcagcatctaataaaacagctttgaaagggcaatattgaaagcactgggtttggaagctactgcaatagtccagagggaaatggtggtggattaatctagggcaaaacagtggagcaagtggaacaaggtatgagtctggattgattttggaggaaaaactaacagtactggttgaatttattgttagaggatgagaaaaagagaagaatcaagatggactccaaggttttttgcctaagccaaatggtgaggaagacttgggggaacactgtttcaggagaggaaaccaagagttctgttctgaaccctgtattagttatctattggtgcataacaaatttccccaaaacctagcagcttaaaaccgtagacattcatcctgtcactctgagtcaggaatctggctatggtttagctgggtgattctggttcagtgtctctcctgaggttacagctgagatgtcagttggggctgtagtcatctgaaggcttgaggggctggaggctctgttcacaacatggctcagagacatgcacagcaggccttaccacgtggccctctccacagtgctgcttgagcgatctcctaacatggcgactagcttccctcaggcaagtaagccaggagatgccaaggctcttacatattttctgacctagcctaggaagccactttctgttatttccacaatgccctatcatttgcacatatcagtcatattcattcagtaggcgaggcacccacacaagggtgtgaataccaggagggaagaatccctggtggccatcttggagggttgctaccacagatcgttagccaactcttgaatttcctacttttagatgcaatttgtctgaaagcataaactgtaaatcctgtttttctctagtcagatgaaagctgggagtaagctatattgttgtgatcaatagattcatttcttggggctgatgcaacaaaggaccacaaactaagtggcttaaaacaacagaaatttattctctcaaagtccaaaaccagaagtctgaaaccaacgtgtcagcagggttggttcctcctggaggctctgaggaataaactaccccctgcctcccttcaagttatttgtttttatggggttttggttttgttgttgttgttgttttgttttgtttttttttggtagagacagggtctcactatgtcatccaagctggagtgaagtggtgcagtcataactcactgcagccttgaactcctggactcagacaaccctcccacctcagcttcctgagtagctgggactacaggtgcctggcaccatgccaggctcagtttttaattattttttatagagattatatcttgctatgttgcttaggctggtctcaaactcctggcttccagtgatcctcctgccttggcctcccaaagcactgggcttagccgcatgaaccaccaggcctggcccctcctagcttctgatggttgccagtaatcctgggcattcagtggcttgtagaccatcactctactctccttccatctcccatcacctttccctctgtgtctctgtgtccctgtgtcttctgtttcttataaggacgctcactggatttagagcccaccctaatcccagtacagtctcatctcaaaccttaccttaattaattctgcaaagaccattattccaaataaggtcatattacgagattctaagtgaacatgaatttgggtaagacattattcaaccctctaaaatcaataatcttccatccccactaacaaagcctgactctattttgctacagtattgcaccaatttctttaatctagtaaatatgctccttaaactacttcaccaaccttactaatatgagaagaaagcaattaattagggtttaaattggttttgttatgactctgttcactgcatacattttccatctactcttagacattatcactaaatgggcaacattttgaaccagaacagttggggctgaagtcatctgaaggcttgagtggggctggagatgcagtgcagatgctcttgcagtttgggtaaatattggcaaaagtgtgtgagtaaacacaggggtgagcatatttttgaatttcatatgtgaaaactgcctattagcaaagtgatgtgcaaaaaactacagacatacattaaattcaagttctaggagatatgcccctgactaacattagacagagtctattttctctgtctctggtagatactgggtcaggatgcaggagctcagttccattcctgcctggttgtgttcaaagcacttaactttcatggggctcaaattccctatttgtaaaatgaagagatttgactaaagtctcctttcatgcctgaaaattcactgattctataggtagctcacaagtaatttatggtgtttattctacttggtgtaagccagcaataactctgtatgctcttaatagcctacttttttattgtgttgatgttttggttgaccgagacagactacatctaaatggctctttacgcttaaggaacagcctgccaatctttccaaagagggatgtttgtctgcaaatagtcagattactattgagtgatcgccatgtagctaagcaccatgatacatgcttgtatatgaatgactcatttaattcttacagcaatcctgtgggacatgtattattattgtcagctgcattttacagatgagcaaactgagacatagatattatatggccttcccgagtcacatagatagtaagggggagaatcttgagcttttaccctatgtatgttactacactagactgctgaactaaagattactataacagcctctgtggattttatattttgatcactgtattacggatagctaaactataactcttaaattatggataactatactataactactatataaaggttttaaatactgtgtattaaaatttttcaagatatttaaattgtatagcatgctatttcagaatccaataaagaaaacatcttatgattcttgaattatactgtccaatacagtagtaatagtcatgtgtggctatttaaagtatttcaatttgactaaagtttaaaattcatttccccagtctcaccagtcacatcttaagtatttaagagtcacagctcatggctcctgcattggtctgtgcagattaagagcatttctctattgaagaaagttctatgcagcagcactgttttaaaatgttagggaagcatatttccattcaaaattgcaagattcgatcatacaatcaattattgtatctatgattatagacctggactgtgtttaataatagctttgtgactttccttatatcccctcgtaaagtaagaattaggccccctttgccccataacagtgtcattggccaccttaaaaggcaaaatctctatcaggaatctatttttccctaagtgtgatgttacaggtttgaataaacacaacagcctcctgctcgccctcctgactagtgagcaaagacagcaaaacgaggtgatatgtagaccaaggggccgaatgtactggctttaattcaaagcttagatataagcaggaaccatgcaagtaaacttttggattcatatttgctaagtgaataaaatattgaaattctgccatatgtaatgaaaaaaaaaaaaacttgtgaggttgtgttaggaagttgttttgggagggaaagtggaggaatcttcccaaaaatatatctgtagttgacatcagagggtaagctcctcaagagcaggaggaatgttttcttgtctttgaatcttcttcccagcccttgtatcacctgacacaggatactactcataatgctttaatgaatgaaacatctcaggccaaatgttaggcttggctggtacacaagtccttgtctatttaaaatgaaaccagtcaaaactaaccaacaaatgagatcacaacaaattatccctcatggcctaaggcgagtagctcaggaagcagcagatattctagaaatgtaaaaacttgtgatacctttgaacaaagtgaacaagaagtgatttttgatgcctttctctggggtctctggaaataccaccttgatggcttcgtttgagatgccaaagtgatgcagggcaggtgaaccccaaaattggggcttagcccatgagcattcttggcttcattcagaaaagaattcaagcaaccctatgttgccttttcaggtgacaggtgacactgcttgtggcaaaaaggggttcattctttatgagaggatgtaaggaaagtcacaatctccaacagccttttattgaactggacctgctgcctgaggagcagggctaactcctaggcagcacacacagagctggacttgctgggctcttggcaactctctttatatccacttatacccatgttcaattatatgcaacttaaggggtgggtgaatgcaaattgaagggcaagttattcagaactctctagcaaaggggcaataacttccaggtcgttgccatggaaatgggcaataacttctgggctgttgccatggcatttgtaaactgtcatggtgctggcgggagtgtcttatgctgatgagcaatgaaggcagctagggattgctttagtagctactggctgccttcagccagtttcttcccttcatcctgtctataccaggtcttgttttagtcatcagggttgtgaccagaaaacaagtcctgtcagtcccatacctcaaaagcacaggtacagccaagaatgcacctatgctgacatctgtgcccagccagcccattcaccagaagaatcttccatgaggagcttgggctcatgtttgttacgacatttggctttcctcccaaatacttgcaccttatcctccctcaagccacaagctgttctgatttagtgagtttagcaaagacttcttgcattttgggcagaggcgagcatctcattttcttacatctttcaaactgaaaccctccaggttgagatgagaaggcttccaaactgaggagagaacatggatggaactggaggctatgttaagtgaaataagccaggcacagaaagacaaatatcacatgttctcactcctatgtgggagctaaaagggtggatctcatggaggcagagagcagattcatcattaccagaggctgggaagggaaggtggggaacagggatgaaaagaggttggttaaagggtacaaaaatacggtcagaaggaataagttctgatagtcagtagtacagtggggagattatagttaacaataatttattgtctatttcaaagtagctagaaggaagatttgtaattgtattagtatgttttcatgctgctaatgaaaacatacctgagactgggtaatttacaaaggaaagatgtttaattgactcacagttccacatggctggggaggcctcacaatcatagcagaaggcaaaggagaagcaaaagcatgtcttacatggcggcaagagagcatgtgcaggggaactcccatttataaaaccatcagatctcatgagacttacaacaagaacagtaggggagaaatcaccctgtgattcaattatctccacccggccccacccttgacactggggattattacaattcaaggtgagatttgggtggggacacagccaaatcatatcagtaatgttcccaatgcaaagaaaagacaaatgtttgaggtgacagataccccaattgccctgagttgatcattacacattgcatacaggtaacaaaatatcacatgtacctccaaaatgcatgcagctaatagatatcagtaaaaataaataagaattaggctgcctttcctctttgagccacaccctaatttgattcttttcagttccataaggcagacaattcaggatctcagggaacagagacaagtccaaagagtcatgattgttcttttatttcctgcccaaaataatgacccgcagtattgggtcatactggctcagcttctggtccacttccaaaggggagatagtgtcaaatgtctgagtagtgcaaggcctcaacccacaatgctgacataatttatctagacttaacctggggaagagtcatggtgatgaataatgttggctgcaactcaccatgctccttggacacaaccaggagacagattcaaagggatgaggtgttttgataccttttatttcatctactgagacagagactagagacccttagtgacattcaatcagaattctgttgcctcgtttgaggtaggttccatgatcagagccagtcacgaactccttctcactttgaggaagtgagaggcaagcttccctctattctgtagttgaaatggaagaagcaagcacacaccccaaagcagctttgcaaaatatcctatatatttgcatacaacatatcttccagaaatgctacacatagatctttgtatagtttataaccagtctgtccattcccttgtcttctaaggaaacgttaaaaaaaaaaaaaaaaaaaaaaaaaacctttacctgaaaatgtcaggtggtttcttgaagggtctttcataaaatttggaacttcaaatacaagttgtcctgagttcaaagaaaacctaattctaagtttaataattcagagaatccaagtgttagcctcctcatgataaattgtcatctgagtctttttatcatttaattattttgttggcatgcatttattagcactaaactaaattaaaagcacttctttagactgaacaaaaatgatgtcattttaacaccttaacaatttgtcataaacttgaacattttcttttttattattattattatactttaagttttagggtaccatgtgcacaatgttcactggccttttcaaattagattctgcttttctaaagtgacataggcttccatagaacgccaattttcttaactatagtttttttttttttttttttcgagacggagtctcactcagccgcccaggctggagtacagtggcatgatctcagctcactgcaaccatcgtctcccgggttcaagcgattctcccgtctcagcctcccaagtagctgggattacaggcacccgccatcatgcccagctgatttttgtattttagtagagacggagtttcaccatgttggccaggctggtcttgaactcctgacctcaggtgatccacctgccttggcctcccaaagtgttaggattacaggcatgagccactgcacctggccaactatagaactttttaactgaatacccaggatgactgaaccacttgcatttagttgatttgcttatgatcactctattgattggctgttgctttttattgttttcttagaaacagggtcttactctgttgaagtgcagtggtgcaatcacatctcattgcagcctcaaacttccaggttcctcccacctcagccttctgattgtctgggactacagacccatgccaccagacctggctaatttttgtgttttttttttgttttgttttgttttttgtagagatgaagtctcactgtgctacccaggcttgtctcaaactgctgggttcaagtgatcctcttgccttggccttccaaggcaccgggattacaggcatgagacactgtgcccagccaattgttactttttatccaagagttggaagagaggtgccttaacgaattcccaagtctatacaacctaaatgacaacaacacattcctcctgttacttttgagcatcacgtcctaccaaaaagagggagaacaacttttcaatgaggcaggactcctatcattatgacactagagtgtaggggaaagttactattttagcccacacacttcagttccatacacgacattctattccggtaggaggctgattgagtgaaagttacatcttcgtttccctgttaaagaagacccggtgtctgcaaaaagtcaatagtaattgagtggctttggaaacaataaatatttagtgcaagtagagtcagaaaagaagaatctgtagcaacattttgaagtcctagggaaaagcatcacttccagagatatgggaaagacgggtacaattcgctgtgtgctcacccacatccttagcccaaatttctgcactgccacagtttctgcttatttcagtgtcaggtgccaaatcctaaagaggaatgcgttattataatctaagaatacactgtacattggggcctattaacagttttgtcatacaaaccaggaagagggaaacgttttctgccctcctaatccaggctagaaagtttacaattcttggtggatatgacttgttgcgttatgttggtttctgtccatgtaacgaacatgcaaactggtcagaaacagattgtatgtaggttaatcctaaatggtcccctattctgtgattgttgcttgaaatagaaatttcctttacaggtgaaagttttgccactaattccttaggttttgtcacctcaaaaggcttggtttctggtaaatattgaatatttcaaaacgggctacataaaatggatatgtgctttaaaataattattgggaaggaattaagcagctggaagttgggagtgggagagcttgtgtcattgcctgacacactaggtcgctaactcctccgtttgttaccaactcacttttattggtaccatgcctataagcaaatcattgtgcaaaagtgcatgatagagacagccagtgagctacaaaccatggtttaaatgatgcggtaatgacagacgagcaaggcattttctggggattaatagccagctggggcaagacgaaggtcctcattgttgccaagggatattaaccccagctgggttttcaatcctaaattgcctacaatgtggcagtgattgctattacatgagtagattgctatatgggagagaggttatattgaacataagaataatactattgttacataaagagcacaactggaagcatttaactttggatgtggaatcactattacacctctgcccgtaattgctttccatgagttattaaatactcacctgtgccatgcctctgatctacaacgcagaacttgggtatctttgatgctgactctgctgatcagtctaataaaccacgttttccattccttggagctccagagcattctttaaaagtgaagatgcatttttttttccttccaacaagggtggaagaaaccttacttttgaagaatgcgttcaaaacaaaaaacagattgatctaggagaggtggtgttacaggctgtttgcttatcttactgtgcccggaattggtgggttcttggtctcaccgacttcaagaacgaagccgcagaccctcgcgatgagtgttacagttcttaaaggcagcgtgtccagagtttgttccttctgatgttcggatgtgttcagagtttcttccttctggtgggttcgtggtctcgctggctcaggagtgaagctgcggaccttctcggtgaatgttaacagctcttaaggcagcgcggagttattcgttcctcccggtgggtttgtggtctggttggcttcaggagtgaagctgcagaccttcgaggtgagtgttacagctcataaaggcagcgtggacccaaagagggagcagcagcaagatttattgcaaacagcaaaagaacaaacctgccacagtgtggaaggggaccccagcaggttgccactgctgtcccaggcagcctgcttttattctcttatctggccccacccacatcctgctgattggtccattttacagagagcccagtggtctgttttgacagggtgctgattggtgcgtttacaatccctgagctagtcacaaaggttctccacgtctccactagattagctagatacagagtgtggacataaaggttctccaagtccccaccagagaagctagatacagagtgtggattggtgcattcacaaaccctgagctagacacagggtgctgattggtgtgtttacaaaccttgagctacatacacagtgccgattggtgtatttacaatcccctagctagacataaaggttctccaagtccctaccagtcaggagcccagctggcttcgcctagtggatcccgcaccggcgccgcaggtggagctgcctgccagtcccgtgccctgtgcccacactcctcagcccttgggtggttgatgggactgggtaccgtggagcagggggcggtgcgcgtcagggaggctcgggctgcacaggagcccacggagggtggggggaggctcaggcatggcgggctgcaggtcccgagccctgcccctgggggaggcagctaaggcccagggagaaatccagcacagcaccggtgggccggcactgctgggggacccagcacacctaccgcagccgctggcccgggtgctaagcccctcatagcccacactcacccgcggaactcacactggcccgcaagcaccgcacgcagcccaggttcccgcctgcgcctctccccccgtgcctctccctccacacctcccggcaagctgagggagccggctccggcctcggccagcccaggaaggggctcccacagtgcagccgcgggctgaagggctcctcaagtgccgccaaagttggagcccaggcagaggaggcgccgagagcgagccagggctgtgagggctgccagcatgctgtcacctctcactattatttgctagcaccccaggctacgtccaggcacacaccaattagattgaggaggtgagagcttatcaatatccccttcaaaggaactgtagccctcatcttatatcactatcaccttttacaacttcctgaattgcttactctaattaaagggagaaaggaaagggtgtccaattcaataatggaaagatctttcataattgccatcaaatggatggtacatggagtgggagggtcgtcaaatgaccaaagcattagatgtgttcattcacccttcattcatgtggtcagagatccagtattgattaagcaagctctcctgtgcacattgttctaggttctgtagaagatatagacattatattccaaggaatatgccttgcatctttgtatcatatagttggggagaaaagtaatagagaaaaattaaaaattaaacaacaatgtgaaccttccaaaaaatatgtcagatacagtctcatctcagtctcactgaatcagaatctctgagactgatctcagatatgtctgaagttcagcaaccaccagaaacggcagtcaagattggtgatgaggctgggcatggtggcacacgcctgtgatgccagcactttgggaggctgaggcaggaggatcacttgaggtcaggagttcaagaccagcctggccaacatggagataccctgactctactaaaaaaaatacaaaaattagccaagcatggtggtacttgcctgtagtcccagctacttgggaggctgaggcaggagaatcacttgaacccgggaggtggaggttgcagtgagccgagatcacaccattgcactctagcctgggcaacagaatgagactctgtctcaaaaaaaaaaagattggtgatgtgatgaatggaaaatatgagaaatcaaactgcagccaacagcaggaagggcaaaggaaggaagtgaaagaaagttcccttagagaaacatattaatccacattctacatcctagagttcaaatgctgtctatgatgcattaggaaactttcgcatttataaatgcagaatctgtaagagaaaagcgttccatctagaaagattttgatgcagagatgcagttttcaaactatttatcaaagacatgacttcaagaacagtaatattttctatcaattttttattgaacttggagataaaagaaaacttcttcattggaggtttgggagcatggaaacgcatttgagaatataattataatccttacccacaagatctcattactagagtttctcttgtttctatcagtgaggatagcaaggaaattagattgaaatcaccaggtacacacatgattttatgagcaaaagtttccgaattgtataaaaacccttctcaaacaaacaaaactccgacttttagttaaaatggaaatgctaagagagaagagatcattagaataacatccaaaaaggaattttcccaaatgagtagagttgtttattctggagggtaggagtagaaagaaacattcaaagatattgtaactttaagtatataaaagttacatactatgtcctgcccttaccatgtagaggaaaaaagcgtttatctaatggagaaaaaaattctgccacaggggaaaaagaactttgtaaaaaatatttaaggaaaattattggactcatgaggcccaacattggattatagacagtgatgtactggtagatttttactaactactttctgggaaggaaaaagagccccgatccgtaacatttgccactgatttcaagccaccaccatgatcgtcacggaatacagagctgggaagagatgccaggtcccacaccattatgtagtgtttcctcttacagatacagtagacataaatcacatcctgagcacagataatagtcaaatgtaataaaatagcaagcatgaggttttgagtatttattaccttttttttagaaatataatttacttaagtttacatttatataatttaagttgtaataatggctctgtttaacaaccggcacccaaaagtcttgaaatgattaacacttgggtctcaagagccatgatgagccagttaggacccagcactgggtagatcgaaccattgtatccaacaaaagagagccacagaagcttcagttctccaagcagccttcctgagtcactcttaaatattttaacattgacttttatcaacagttaatatgagaccctattaaacaaacagagctttcactgagaagctctgttaaaaacactgtttggctctaggtcagtggttcttaactggggtgattttgttcccctggggacaactggctgtaactagaggcttttttttttttttttttttttttttttgagagggagtctcactcggttgcgcaggctggagggcagtggcacgatctcggctcactgcaacctccgcctcccaggttcaagcaactctcccgcctcagcctcctgagtagctgggattatagggacccgccaccatgcccagctaattttttgtatttttagtagagacagggtttcaccatcctggtcaggctggtcttgaactcctaacctggtgatctgcccaccttggcctccgaaagtgctgggattccaccacgcccggccggcatctttgattgtcacaactgagggagggtgctattagcatctagccaggggccagggatgctggccaaacatcctacaatgcagaggacaggcccccccacccccaccctaactcagaatgctgacagtgcttaggccaagaaaccctgttgtgagtcttgtgtaatctgtgaaatatactacgatttttttttctttttgagacagagttttgatcctgttgcccaggtcggagcgcagtggcgtgctctcagctcactgcaacctgcgccccccaggttcaagcgattctgctgcctcatcctcctgaatagctgggattacaggcgcttgccactatgccaagctattttttttttttctggtttttagtagagacagggtttcaccatgttggccaggatggtctcaaactcctgacctcaggggatccaccggcctcggcctcccaaagtgctgggattacaggcatgagccactgcgcccagccaatacatttctttataacttactgccagtttctctcctaaaatatttccgtccatctgataagaattttgtcacccattatgtttctcctttgtccttcactagcagtaactatataaattctttgcttgctcctttttaggactctgattttctgtttttattttaaccttattatacacagtcttttattaatgagataaattctccttagaaataggaagaagataaatggatggatagatggatgcttggatagatggatgcttggatagatggattcacgcttcgacgcttagatggatggatgcatggatggatggatgtgtgggtggatggatgaatgcttgggtgggaggaaaaaaaagttaaaagagagaaaattaaaaaggaaggaggaaattttgccttgaaatgcaaaacaccaaaaataattaggtggctgccagtataactcttaaaaactttatatgaaatatatttaaataaatacttttactttcagagaaaaaatgatccctatgctcttgcatccctggtgtcctttgaagttaagaagatgccttatacagatcagccagcaaaactcccagaaggaagcatagcagtgagtatctttaaatatatataggcacaaataatttaattgaaataattgttttaatcactgtctagcttgtgctaggctttagtgtttacattgacttgagaaaaattttcctcttcagctcaccaatttcttacattggtctggtaatttcctagtgccttttgatctggtttttgaactttcaatataaatgtctaccccagaaaattacagggcaggactaataccatttttaaatgaagacattttattcagaggaattcagatagcagttatcattacaatgaaatcgtactgattctttcattttaaacagcatggttagtcaagtaagaagggaagaaattctttcttagggatagtaggctacggagcagccgcatggctttggacagtcattttttcttgctatgcaaagaaccttcattttgacctagaagggaataaaaaagtctactctgagcttcaactgaatgaaatgtcttttttttttttttttttttttgagagtctcgctctgtcgcccaggttggagtgcaggggcacgatctcagctcactgcaaccgttgcctccgaggttcaagcaattcttctgcctcagcctcccgagtagctaggactacaggtgcctgccaccacgcccagctaatttttgtatttttcatagagacagggtttcaccatgttggccaggctgatctcgaactcctgaacttgtgatccgcccgcctcagcctccgaaagtgctgggattacaggcataagccactgcgcccagctgaaatgtctttattaaaaactgaaactactaaacattactgacacccaaacatctatcacagaacaactctgatcatcctctgcaacctggcaaggccatgcaaaggggataaaggaatgaatgatgagaccagcaggcaccatcaccaaaactctgccttttcagttatttgtgaaggtggtcagagacttttgaaaagcatagtgctccaaaaaacaatattaggattccaccttcatcccttggtagccagtggatatttcccatccacagcttgaactcttggtcccccagaccttgttactcaaaatgtgattgcagatcaatggcatcagcatcatctgggaggttcttagaactacagaaacagacctctccagatctgctgagccaggctctgcattttatcaaaatcatcagagcattcctaggcatggtcaagtttgagaagcactgctttggatggtagataagttgataatattgtcatctctttctagcctagatcataaacttaattgtaacactgaatctttctagcctggtctactttcagtgatctaaattaaccacttgatttgtgtttctctaccctgagtatgcatcagaatcatcactcatgcaacttaaaaatacatacatgctaagacttctccccaaatattcagtaggtctggggtgggaccctgacactgtgctttaaaagtcttatgagagacaattctgcaggggagccagggttgagagcttctagcacaggcaggtggcctagaggaaaatccaaggttttcaagatagagtcacctgggtttgatcctggctctgccttgctctaattaggaaacctttgggaagtcactttacctctctgagacagtccaccacatccacctgatggaattgttaacaagatcaataagattatctgtataaagctctagcattgtacctggaacaagttagtgtcaaatctcaataaatgagagtagcctctcaaaatgtctccccttctctggctaagtccagtaagtgcaaattgaaagtgacaattaagatttgcacagttgtgggaggatcacttgagccctggagttcaaggttacagtgagctatgatcgcatgcactgcactcaacctgggcgagacctcgtctcaagaaaggaaggaagaagggaagaaagaaaggaagaaaggaagaaaggaagaaaggaaggaaggaaggagaaaggaagggagggagacagggaggaaggaaggggaagggaagaaggaaggaaagaaagaaggaaagaaagaaggaaggaaaggaaggaaggaagggagaagaaagatagatgtgcacagttaaaatatttcagtaaacttcggtggtatttaaagcaagcacagccacatctttcttcatttagaccacctctttttctttccagtgatgtcctctgtgttttggatttatgttcaacctagaaaacagaggctttgggattttaatatagaagtttcatctaaaaatgttcaaaggcttatagctctaagggaaataaatctgggcccttttgttttttccaagcacgtgctccctagcagaaacacatgttacggttggttccatccacaggattgcatctttctgcactggccacaggtgacagcctgctgttctcaactcatctcaaaagatccacaaaataatccgatacatgctttccccagccctgccacccctgttattgaattgccaaaaaaaaaaaaaaaaaagactttttatctgatgtaggtgatttaccacatcagttatgtgaaggttattgggaaaagatccaggaatggaaacaatttcaagtctcccaatatctgactaactggagaagaccttgccagtgcaaagttagctatgcagcacacagggaaatgctgccttactgtggcttgatgtgagagaagaactctgagtggagctggcagacatttttttatagtgagctcttttcaaaggctttgccattcttctcttgaagggagcccagcagggccaagagggcggctcacacctgtaatcccagcactttgggaggccaaggcaggcagattgcttcagctcaggagtttgagattagcctaggcaacatagtgagactctgcctctacaaacaaacaaacaacaacaacaaaaagcataaaattagcaaggcgtggtgatgctcgcctgtagtcccagctactcaggaggctgaggcaggaggattgcttgagcctgagaggcggaggttgcagtgagccgagatcacgccactgcactccagcctgggcaacagagcaagaacctgtctcaaaaaaaaaaaaaaaaaaaaaaaaaaagcccagccgaaagggaattgctttaaggtggtagaatccattggaaatggtagttggagaagcatcagagctctaatctgcccctgaggaaagtcattctttgttccttcttctataatgagactactatttgcttgttttcctagacccttttgtgtgatgattagtttgtttgtactcccttttcaacacggtcataattcagccatctcttgaggcccgtattagctttacttatggaagagaatcacaattcccgtttgctgcttgcatagtatctgtgtttgtaacaaataaaattcctcatgtcctgtgatgcttgtcatgtccggagacaagggaaagattgcatgattcgaagaaatatgcctgaacactgaatcgttacagtgcaacagaagaaactgaaattcaattatttgaacacttttttggctcaccaaggaactttcgcctttgcatgccatacaagtaacactcaattctataatttacatctagcagaaagtgggagtgtcttgtgtaattccaaaggtggttattacaaaatatttcatgaaaatcttcatttaaaaactcatatgtaaactgtgaacccatttggttttcagaattgttagcaaaacttctgcaccttaataccttaatatggaactcttatattaaacaattatttggagttgaaatttatgatgggaactgcttgtctcataaggaaactgtttaaatgttgtcaaaatgtgggctcagctagtacacctcatgttattattttgttctaaatggcaccgtaggtagggtgtcttggtacgtttatttaaaacattcttctgaccccactgaagtatgtttacacaagattttgtgatacataaatagagacgtcaacattaattaccattgcaaatacaagggagctttttccttctaccttggtattttttgtgaaaatatacaaaaacatatcataaatgtccacaataaaatgtaggcatattaaaggtttatttatggtctttcctccataataaaaaacaacaagatttatgacatgatgaaggtaagattaaatgttccctacttagaatcattttaagaaaatctaaaccacttacaatttatgaatactactttctaaaattgcagacaattataataaagtgatttgttaaacttacttaaagctatttttaaaatagctagaagtacttgataaataaaactgtattaaaatagtttattgactagctggcacaagattgaattgttctccctaaatttaagtactccagttactcaacatgaaacttctttcttaaagcaactgaactatctcatcacaagcccctgtgccgaaagtaaacctctagtcctaaatatgctttgtcttctgccctgagtctaccttcttggtaaaagaatcttataatgggccgggtgcggtggctcacatctgtaatcccagcactttgggaggccgaggtgggtggatcacctgaggtcgggagtttgagaccagcctgaccaacatggtaaaagttcatctctactaaaaatagaaaattagccaggcatggtggcgcatgcctgtaatcccagctactcgggaggctgaggcaagagaatctcttgaacctgggaggcggaggttgcgatgagcccagatcacgagataacactccagcctgggcgataacagcacaactccgtctcaaaaaaaaaaaagaatcttataatgaaagatttgggtaattcaggcaatctcatcattgtgtgaaattatacagaatgttctagaactatgcagtccaacatggtagctatttggctagtggaactgaagaacttgtggttttatttcattttcacacatttcaatgtaaacttaaaaactgaagcagtagatagtatttttccattaaacacggttgtgttactttcacaggactacatttcactttaaccattaaaaatttagcaattgttatgtgctgcaaatgtgaaatacatattggattttggagacttagtaaaaaaatgtaaattattagtatttttatatcaattacatattaaaatgataatagtttaatcattaataaataatacatgattcataataaagaaccaattacatgttgaaaggataatacttttatcattaataaataatagttgatatttagggttagataaactatgttattaaaattaacatcccctgcttcttttcactcctttttttttttttttttttttttgagatggagtttcgctcctgtcacccaggctggagtgcagtggctctatgatgtcagctcactgcaacctccgcctcccgggttcaagtgattctcctacctcggcctccctagtagctgggattacaggtgtgtgccaccacgcctggctaattttgtattcttagtagagatggggtttcatcatgttggccaggctggtcttgaattcctgacctcaggtgatccgctcacctaggtctcccaaagtgctgggattacagatgtgagccaccgtgcctggccctttattccttttaacgtgactattagaacattttatgttatgcttgtggcttgcattgtatttctattgggcagtgctgatcaagggcaaggttatgtcttgaagctgataatacctacagaacttcagagaacatagggtgtttaataaatattatttgaaatgatatttcaaatcaaatcaaaccaccaggcatggtggtacacccctgtagtcccagctactcaagaggctgaagcaggaggattgcttgagcccagaagttggaggctgcagtgagctatgatcatgctactgcactccagctgaggcaacagagcaagaccctgtctccaaaaatacataaataaataaatattatttgaaatgaatgaaagattcttcatatatgtcagtgtttagtcatgagaaactctaacatttatgacttatttttcctcattatttattatctaatggctacttctatctaagcttcctgtaggtttgtcaaaatgagctgtaagacaaatatagatattagaaataacaaagttttggtgtttgtcaatattttctttcctgcccaagctttccccaaaactagcctgcagtcccacagcactaacacatatttaaagaaactttggtcctgtaaaagtgatcagttaagtcgtcttctcttaagcttgcctatgcagtcaagtctctagtttatctatacagagcgtggagtttcaggaaaagctttgctttactggtttccacctgcacatggaatgccccattgccatttactgatttagagacatgaatatgtcacatgactccccatcactctatcccagaaagacctctcttgccgagacatatacgtgactcttctaatgatgttgtgtgcagaggcaaggacaaggtcgcctgattcagagaaatatgtctgaacactgaatcattacagtgcagcagaaaaaaattattcagttatttgaataattacctttggctccttgtctaactctttccagtaagagtcaagcatctcctctgcacgggacaccagatgaaatgctctgggtcgctgttgttggttttctgtatttccactgttcttactgtagtgacttctagactatgctgcaaaagcctacataagtttaggaaaacaacaagggtgaaggaaggtctctgcagctgcaccaattttagattgagaagattgggccgcctcagtaccatatggatgtcctacaggtaaaaggaccaggaaagcagaaagcaggcatgggaggagagtcactcagaggttgccttcttttaagactctgtgtattctttcccgctaatgaattgcacaggatgacatggaggaaatgcatatcatatgcataatcctgacatcagagaaaaggtatgaagtgttttttgtttttttgttttgttttgtttgagacagaggctcgctctgttgctcaggctggagtgcagtggtgcgatcttggctcactgcaacctctgcctcccaggttcaggtgattctcctgcctcagcctcctgagcagccgagactacaggtatgcaccaccaccaccacaactgtctaattttttttttttttttttttggtatttttagtagagatggggtttcaccatgttggccaggctggtctcgaactcctgacctcaagtgatccatctgtctcagcctcccaaagtgctgggattacaggcgtaagccaccacacctggcccaaagtggtattttttaaacaaacttaatgttactggaagcagactggcaacagttttgatgatgagaatttcagaatttgggaactgaaagggactttccgaatttgtgatcactgcagggggtcatcttcccacagactttttaaagacgctgctgtcaggctctttgggagcaaatgtaaacagaaagccagtacgttctgtaactatccctataaagttgttctctgcttcaaaagaccctaagaatcatatcctcatcaatttcacattttcattatactttttcatcactgctacaaaaaaaactttaaatgtctttgttagctctttgtaagtgatcttctctgcttatttctctggatagcccagttatatagatgatacatcaaaacctgcaataaccaaggggcaaagtcacctagcaaagtactcagtaggtatccactcagcccattccatttctttttattaagctaacaatttgaagagcctctatttcaactcctttagcatgttttgtgttttctctaacttataaaacttgaactcttttctgtttaacataaaatagtaggcaggaacttaagataataattttttttttttttgagactgagcctggctctgtcaaccagacggagtgcagtggcaccatcttggctcactgcaatgcaacctctccctcccgggttcaggtgattctcctgcctcagcctcccaagtggctgagactacaggtgtctgccaccatgcctagctaatttttatatttttagtagagacagagtttcaccatgttggccaggctggtctcaaactcctcacctcaggtgatccacctgccttggcctcccaaagtgctgggattacaggcatgagccactgtgcccagccttaagatattaattaggtaaaccaggagaggaaagatccattgcctggctcaccctgaattacctattagaaaattttggtgagctctgacacatgctcaaagtagggactaaaactatattgtgtcctcaatggacttgggggttatgaggaagtaatatttacatgaaacctcggaattttccatggctccagatttctctcctggggtcattgtaactggcctgtgagtagatgatcactactgtccccttcagttccaaaattctgaaattctcattatcaaaactgtgtgagtccacttccagcaatattatgttcatcttgaaataccacttcatgctgttcctctgagtgcagtcaaatgttaggattcagcagtaatttcatacatgtcatcaggtgtaattgactaaggaagggtacataacaagagaaataatctagttcttgatttgctcatgtagctgtatacatgcaaataattattttctattgatatataattgtacaaatttgtggagtacatgtgatattttgatacacacgtgcacataacgtatagtgatcaaatcagggcatttaggatatctattgtctcaaacatttatcgttgctttgtgttgggaacatttcaaatctcttctggctattttgaaatagataataaattattgttaattagaatcaccctactgtgttactgaacactagaatgtatcccttctacctgactatgtttgtcagccaacttctgttcatccagccctccccactctttgccagcttctggtaaccatcattctaccctctacctccatgagatccacttgtttagctcccacttatgaatgagaatgtgtaatatttgtcttagatcatttcagaataaattacttaggctgcagcatccaggtagaattgcaaccacggtgggtccttgaaattgatttcttcgacgtatgaactacgtttctcatccttaaacagtggtgcgcagagtgtacgtaatgtcaccgtggtgatggactgtcatgcttcacactgatgtgtcagatgaaataaagataagatgaaataattcctagcgaggaaagttaacaggcataggaagaaaatgtaatgatgactaggttgaggccagcctttttctcatgaagaacatctatcacatccttggcatgttcctgttaaggtggaatgactctctccctatctcactcctctgtccatgcctttattagtgtacatataaatgacatttggggctggagaatcgaatgaattgagtcatcagcatctgctgcatgggggatgcggatcaagaaggaaggagcaataaaaaaccaagacaagctgagaagggcaccatcagggcgctcaactctagttaagaagacagaagcatctgggcacagtggctcacacctgtaatcccagcattttgggaggccgaggcgggtggatcacttgaggtcaggagttctagaccagcctggccagaatggtgaaaccaggtctatactaaaaatacaaaaaaaaaaatagctgggtgtggtggcacatgcctataaccccagctactggggaggctaaggcacaagaattgcttgaacctgggaggtggaagttgcagtgagccaagatcgtgccattgcactctagcctgggcaacagagtgagacactgtctcacaaaaacaaagaaacaaatacacaaaagaagacagaggcaacaaagtgagcatggttagggctcagtgctagggttcaggctgtgaaaacaccaatacatttcctgctagggcaaatctcagagccgccaaccttagtcattagtctcagcctctcctgacgggtgggttatagaatgtgtcctggagttcttgagtgtgtttcaggattgaaatgatcctttcaaccaacacaattaaaactaggagaccttagaccagctgagtggaggcaatgcttgccactctgataaaaccggaatactacgttagtgaataatgtctgcatccaagaataatgtagcgctcttttctttgacaaaaggttttagcagcatggctgggtctctccttgggaatctgcagcttctttgctgcctcggcctccggaggcacaggcctccaacacaggagcaatagaagtgcttctgcccacatagggagtggttcatagacactgagcatgcagtcagattgggaaggtctcattttcctctaagcccccttgcaacagtgcgggatgaaatgggctccagtccccatatgatctttgtttttgtgtttttgttttttggcgggaaggagaaagaagagtgtcaccctgttgcctaggctggagtgcagtggcatgatcttggctcactacaacctccacctcccaggttcaagcaattttcgtgtgtcagcctcctgagtagctgggattacaggtgtgcgccaccacacccagctaattttttgtatctttagtggagatggggtttcaccatgttgccaagtctggtctcgacctcctgagctcaggcaatccacccaccttggcctcccaaagtgctaggattacaggcatgagccaccgctctggcctgatctttggatttaggattaaagtcatctccaacgcatcaaaaaaaattgaacattcactttgcacactacagttacttccataaaatacaagatgcctagcctcatgctctgggatatccttcactgatacagcacagaatctagggataaagagacctagtattgacactaattcgttgtgtgaatgaatcacttagtccctctgggagttaattttctcacctgtaaaatgaggggattagattagagatttctacccttcttgcacatccaaggattcatggttgttcacaagcttacctctctcaatgaggctagctgagttctaaggagacacatggtagacagattcattcagttttttattgagtctacttttggccattgttcccataaaagttccagcccaagtgaaggccattcctttccaccttgtcaattcctgatgcactcaattctattctagggtttctgtgatgcaaagccacccacccaccaaatctctaattagacttttacagaaccaagcagatctaggaacatgctagcttttaagagttcatgttcgagtgctacctctcaaatatcccctagatgatttcaattgtcatatggatcctttcagatcaacttccgatgttgtactggtaattactattttatttcaccaaatagttttcgcattagagctcatttgctttgttttccatttcagattaagacatcagttatttgggcaactccgaatgtttccttctcaatcccattatgggtaataatactagcaatacttcttggattgttggttctcgccattttaaccttagctttatggaaggtaagttgatttactttgttttccttttaaactagaggggctgttgagggaatttagagggatacagttagggattttaaaagacaattatggaggcatttttggaaattttgaacagtctgaaggatataaagggaaaatcgtgtcttgtttgctttggcatacttaatatgtttatatagctgacatttaagatgactagaggtgcttaatgttgctttcatcttgagatttcttgtaaataaatgtagagagagttaggctgtattaactaaggcctgtgatcttctttccaatatgcttagagtgataatattctaatgaagacttctttttcttgtttaattaaccaagatcataagctttttattgacatggccctatcatcaatcctttgacattttttataagcactatgcaaatgcaattaatataggtcaattctgatttttaatttcaactactaatgaggccaaatagattatgcatgtgataggatgcctggacttggtttttaatcttgccaattagtttgtctccactgggaagcctgaacttagtctttgatgtgttttactgaggtttgttctaaaagtccacaacaggaattaatttctggcccaccaacctaaacaattgccaagtttcacagagccttccattcccaaatggaaatgacgtcccagttacataagagtaattaacccagtcacatctttgataactatgtggttttccctaaaatcatagtgcgcttttattttgaaacaatatgcagcatgactaatagacctataaactgagaaaaccttggctttgagttaaggaatggcgtttctgatcgttatcagctctttgtgccatcctacacccatgtggtctatgacatacctttagaatggacttttgtgttgttctgtcactcatagtaactgtatttccaatgagtataagatacaaccatgtgtgccaattgacaggatattccagtagctctgagaaagagagatgactcaatgtctctaagccaaacccagttaattggcttccaacatgagaaacagaagaaagaattgaggttccaggtgtctaggaaaatatgtagtttacttggcaaagtactaatttgacactgaagaggaggaaaatcctagagtcacctcttccctgagtttctggctaacctttggaaagtcactaagattctgtgcctacctggttctggcattgaaataagtgacaaatctattctccctctatatatgctctatgttccaccaagcaccgagggatgtgtggccatctcttcacttctttctataatccaccccaaagcagctgacaggatactttaggagacaatctccttttcctagtcaatagttagtgcttctgctccagtaagcatgtgggaaatccttgggacacattgctgtgatctcaggaaaatatccaaggtccataagtggtttgtatgaaagagggacatcttccactccaactacaggacaggagaaagggtgtgagcactctgccctcctgctcaccttgcctatgcaataaactcctctctacaagtaacaaacactctgctcgaacctcctaatttggagaaacagactgattatacgtgcagagctccaggctccttcgaaaatacataaagggccaggtgtggtggctcacgcctgtaatcccagcactttgggaagctgagacaggtggatcacttgtggtcaggagttcaacaccagcctggccaacatggcaaaaccccatctctcctacaaatacaaaaattagctgggtgtggtggtgcaggcctgtaatcccagctactccggaggctgaggcaggagaatcgcttgaaccgggaggcggaggttgcagtgagccaagatcacgccactgtactccagcctggggaatagagagcgagactcagtttaaaaaaaaaaaaatacataaagtgaaaattctttgaatgaggggtttcacaggttcccagaatgacgtgattttatagcccatctttccctttatagtgtggattctttgacagagccagacctcctcaggaggacatgaccgacagggaacagctgacaaatgacaagacccctgaggcatgacaagaaaaaaaaagaagaccaaagacctcaaacactggtcctgttcaaagaaaaagaaagaacatgagggttaaaaatcaaagctttctgatacctgacagtgacccaggaaatggaggggaccctggaaacatcacctcatctacaccgcactttggagaaattgtcctgggtgcccagtgagccctgttggaaaaggaaacaccaaagctggagaagccatcagcaattgtggaagattttcttttgctttaatcgttctgtacttggcagacactttgaaatgcgtatgggaacgtaagttgcagtccagatcaatccagcataagttgcagagacgaaatgtctgaatcactatagaatttacaaggtgaactaaggtgaaatgactgatttactatagaacttagaactaagaccacaccatccaacactactgtatccaatggaacatttgacacctccctatggaaaagaaacatttctaaggacattatggctcagggagacaagcaatatgttgttggtactgtgaaagtacttttgaaaggacaaaaataatcttgtgagtgagggtgagagtttatttatttattttccatgtctctaggttgagaatctgtcatctagagaatttggaaattaagatttggttagctagttttcaaaatcactcactcagtttcctcctaagaaccactgtgtgcagataactcatttagcagagcttcttcagaatttagacagtgctaaggaaaggaagattggcattaggaatcagttctatttaataccttgctgccttccatctgaaattcctttcactcacattatccagggactcacatctgcttaatttagctttgcaagatgttgcatttatatttccttgtatatctttccattgacttagttaatacatgaatttcgaggtactctctacctttggagtgtttaaaagtcatggtaaaatgtctagagttcattaattaaaaagcaatttaacattatgggtaaacattatttttaatatctataagaagcaacacttcttatagatatttagcttgggattaaatacccgtttttcctgctatgccttgtacttgtatacacagagaaaacatgttgaatataacttagacaaaaacataaaattatacaggcatgagccaaactgggaaaactgattcctaaagatttttatttaaaattgcttattccaactttattacttatttttactgctaatctttataatatgtaactttggagaataatcttttatttaagctattttcccatcatcttgaatttaaccatcacaaattttttatgtttaaaactcttgtaaataattcataatcttgtaatattatcatttttgaagtaaaattgaccagccaaatttataggtagtctgcacaattttgtatccttttttaataatgaaaaattactatgaagaaatactgaacaaatttttatgtgcaatattttatagacctatgtatctgaagcatgtttacactggcgtttttttttttaattaatttcctaaatgttaagtatgatagaacaagctgacccaaatccttaagtttacaaagctgttggaaaactttgtgtcctgatttcaacaatcacgctttgtttgaaagatgagccaagctcacagacactaaattttatgtcatgccataagctggagaggagccatttggctacagctgcggaacttcattgaggagcaaatgaaaggcacatggacgagcacgctggtgcagttcatgttcttcctgcctgtgaattgaatactgt

SEQ ID NO: 33 - DNA, 3962 bp, Homo sapiens
cgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaactggacatggctcgagggaagaatcggggcacgtcctgcggaaagacctgccgggaagaccgcgatgatgagtggatgggggtgagcctggcccgacagcccaaggctgatggccgtgtgttggcctgtgctcatcgctggaagaacatctactatgaagccgaccacatcctaccccatggcttctgctacatcatcccctccaacctccaggccaaaggcaggacgctgatcccttgctatgaagagtataagaagaagtacggagaggaacacggctcctgccaggctgggatagcgggcttcttcaccgaggagctggtggtgatgggtgctccagggtcattttattgggctggaaccatcaaagtgctgaaccttacggacaacacctatttaaaactgaacgacgaagtgatcatgaacaggcggtacacctacctgggctacgcagtgaccgctggccacttctctcacccgtccaccattgatgtggtaggaggtgccccacaggacaaaggcatcggcaaggtttatattttcagagctgaccgaagatcaggcaccttaattaagatctttcaagcatcaggtaaaaagatgggctcttacttcggctcctccttgtgcgcagttgacctgaatggggacggcctctctgacctgctggtgggggcccccatgttttctgagatcagggatgagggacaggtcactgtctacatcaacagaggaaatggagccctcgaggagcagctggctctgactggggatggtgcctacaatgcgcactttggagagagcattgccagcctggacgatctggacaatgatgggttcccagatgtggccattggtgcacccaaggaggatgacttcgcaggggcggtctatatctatcatggtgatgccggtgggatagtccctcagtactcaatgaaactgtctgggcagaagataaatccagtgctccggatgtttggtcagtccatatcgggaggcattgatatggatggaaatggctatcctgatgtcactgttggagccttcatgtccgacagcgtggttcttctcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcagactgtttttgaaaggaattgccgttcagaggactgtgccgcagacctgcagcttcagggtaaactgctgctctccagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggaggagatgggcatctcctgtgagctgctggaatcggacttcctcaaatgcagcgtgggatttcctttcatgaggtcaaagtcaaagtatgaattcagcgtgatctttgatacaagccacctgtctggggaagaggaagttctcagcttcattgttactgctcagagtggcaacacggagcgctctgaatccctgcatgacaacaccctcgtgctgatggtgccactgatgcacgaggtggacacgtccatcaccggaatcatgtctccaacctcctttgtatatggcgagtccgtggacgcagccaacttcattcagctggatgacctggagtgtcactttcagcccatcaatatcacccttcaggtctacaacactggcccaagcacccttccagggtcatctgtcagcatctctttccctaatcgactctcatctggtggtgcagagatgtttcatgtccaggaaatggtggtgggccaagagaagggaaactgctctttccagaaaaacccaactccctgcatcatccctcaagaacaagaaaatatcttccacacaatatttgcttttttcacaaagtctggaagaaaagtcttggactgtgaaaaaccaggaatttcttgcctaacagcacactgtaactttagtgctcttgctaaagaagaaagtcgtactatagacatttacatgctgctgaacacagaaatactgaaaaaggacagttcgtctgtcatccagttcatgtcccgcgccaaggtgaaggtggatcctgccctaagggtggtggaaatagctcatgggaacccagaagaggtgacggtggtcttcgaggccctgcacaatctggagccccgtggctacgtcgtggggtggatcatcgccatcagtttgttggtgggaatcctcatcttcctgctgctggccgtgctgctctggaagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaa

SEQ ID NO: 34 - DNA, 5189 bp, Homo sapiens
gggaaagtgaagaaaacagaaaaggagagggacagaggccagaggacttctcatactggacagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggaggggggacgtttatcgctgccctgtagggggggcccacaatgccccatgtgccaagggccacttaggtgactaccaactgggaaattcatctcatcctgctgtgaatatgcacctggggatgtctctgttagagacagatggtgatgggggattcatggcctgtgcccctctctggtctcgtgcttgtggcagctctgtcttcagttctgggatatgtgcccgtgtggatgcttcattccagcctcagggaagcctggcacccactgcccaacgctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattcttcttcaatgtcacagatgaagctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggggcctatgactggggaggctctgtgctatggcttgaaggaggccaccgccttttccccccacgaatggcactggaagacgagttcccccctgcactgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtcttcgtgaagctgactgccagcagtgacagcctggagagaaatgggacccttcaagataacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatgaaaaaaaaaaaaaaaaaaaa

SEQ ID NO: 35 - DNA, 5035 bp, Homo sapiens
gcaggcgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccatgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaaaaaaaaaaaaaaaaaaaaaaaaaaaa

SEQ ID NO: 36 - DNA, 3912 bp, Homo sapiens
ctgtgctctgtccccaaccttccacttcccctcaacgcgctgctcagggatgaccttcggcactgtgcttcttctgagtgtcctggcttcttatcatggattcaacctggatgtggaggagcctacgatcttccaggaggatgcaggcggctttgggcagagcgtggtgcagttcggtggatctcgactcgtggtgggagcacccctggaggtggtggcggccaaccagacgggacggctgtatgactgcgcagctgccaccggcatgtgccagcccatcccgctgcacatccgccctgaggccgtgaacatgtccttgggcctgaccctggcagcctccaccaacggctcccggctcctggcctgtggcccgaccctgcacagagtctgtggggagaactcatactcaaagggttcctgcctcctgctgggctcgcgctgggagatcatccagacagtccccgacgccacgccagagtgtccacatcaagagatggacatcgtcttcctgattgacggctctggaagcattgaccaaaatgactttaaccagatgaagggctttgtccaagctgtcatgggccagtttgagggcactgacaccctgtttgcactgatgcagtactcaaacctcctgaagatccacttcaccttcacccaattccggaccagcccgagccagcagagcctggtggatcccatcgtccaactgaaaggcctgacgttcacggccacgggcatcctgacagtggtgacacagctatttcatcataagaatggggcccgaaaaagtgccaagaagatcctcattgtcatcacagatgggcagaagtacaaagaccccctggaatacagtgatgtcatcccccaggcagagaaggctggcatcatccgctacgctatcggggtgggacacgctttccagggacccactgccaggcaggagctgaataccatcagctcagcgcctccgcaggaccacgtgttcaaggtggacaactttgcagcccttggcagcatccagaagcagctgcaggagaagatctatgcagttgagggaacccagtccagggcaagcagctccttccagcacgagatgtcccaagaaggcttcagcacagccctcacaatggatggcctcttcctgggggctgtggggagctttagctggtctggaggtgccttcctgtatcccccaaatatgagccccaccttcatcaacatgtctcaggagaatgtggacatgagggactcttacctgggttactccaccgagctagccctgtggaagggggtacagaacctggtcctgggggccccccgctaccagcataccgggaaggctgtcatcttcacccaggtgtccaggcaatggaggaagaaggccgaagtcacagggacgcagatcggctcctacttcggggcctccctctgctccgtggatgtggacagcgatggcagcaccgacctgatcctcattggggccccccattactatgagcagacccgagggggccaggtgtccgtgtgtcccttgcctagggggagggtgcagtggcagtgtgacgctgttctccgtggtgagcagggccacccctggggccgctttggggcagccctgacagtgttgggggatgtgaatgaggacaagctgatagacgtggccattggggccccgggagagcaggagaaccggggtgctgtctacctgtttcacggagcctcagaatccggcatcagcccctcccacagccagcggattgccagctcccagctctcccccaggctgcagtattttgggcaggcgctgagtgggggtcaggacctcacccaggatggactgatggacctggccgtgggggcccggggccaggtgctcctgctcaggagtctgccggtgctgaaagtgggggtggccatgagattcagccctgtggaggtggccaaggctgtgtaccggtgctgggaagagaagcccagtgccctggaagctggggacgccaccgtctgtctcaccatccagaaaagctcactggaccagctaggtgacatccaaagctctgtcaggtttgatctggcactggacccaggtcgtctgacttctcgtgccattttcaatgaaaccaagaaccccactttgactcgaagaaaaaccctgggactggggattcactgtgaaaccctgaagctgcttttgccagattgtgtggaggatgtggtgagccccatcattctgcacctcaacttctcactggtgagagagcccatcccctccccccagaacctgcgtcctgtgctggccgtgggctcacaagacctcttcactgcttctctccccttcgagaagaactgtgggcaagatggcctctgtgaaggggacctgggtgtcaccctcagcttctcaggcctgcagaccctgaccgtggggagctccctggagctcaacgtgattgtgactgtgtggaacgcaggtgaggattcctacggaaccgtggtcagcctctactatccagcagggctgtcgcaccgacgggtgtcaggagcccagaagcagccccatcagagtgccctgcgcctggcatgtgagacagtgcccactgaggatgagggcctaagaagcagccgctgcagtgtcaaccaccccatcttccatgagggctctaacggcaccttcatagtcacattcgatgtctcctacaaggccaccctgggagacaggatgcttatgagggccagtgcaagcagtgagaacaataaggcttcaagcagcaaggccaccttccagctggagctcccggtgaagtatgcagtctacaccatgatcagcaggcaggaagaatccaccaagtacttcaactttgcaacctccgatgagaagaaaatgaaagaggctgagcatcgataccgtgtgaataacctcagccagcgagatctggccatcagcattaacttctgggttcctgtcctgctgaacggggtggctgtgtgggatgtggtcatggaggccccatctcagagtctcccctgtgtttcagagagaaaacctccccagcattctgacttcctgacccagatttcaagaagtcccatgctggactgctccattgctgactgcctgcagttccgctgtgacgtcccctccttcagcgtccaggaggagctggatttcaccctgaagggcaatctcagtttcggctgggtccgcgagacattgcagaagaaggtgttggtcgtgagtgtggctgaaattacgttcgacacatccgtgtactcccagcttccaggacaggaggcatttatgagagctcagatggagatggtgctagaagaagacgaggtctacaatgccattcccatcatcatgggcagctctgtgggggctctgctactgctggcgctcatcacagccacactgtacaagcttggcttcttcaaacgccactacaaggaaatgctggaggacaagcctgaagacactgccacattcagtggggacgatttcagctgtgtggccccaaatgtgcctttgtcctaataatccactttcctgtttatctctaccactgtgggctggacttgcttgcaaccataaatcaacttacatggaaacaacttctgcatagatctgcactggcctaagcaacctaccaggtgctaagcaccttctcggagagatagagattgtaatgtttttacatatctgtccatctttttcagcaatgacccactttttacagaagcaggcatggtgccagcataaattttcatatgcttaagaattgtcacatgaaatgaggatgtttatagcacactttccttgcgtggaagagctataacccagggacctgagtgcctctctgggaatagtcgggggaacctatttgtgggcattgaaaaagttttttcactttc

SEQ ID NO: 37 - DNA, 3878 bp, Homo sapiens
ccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggccctggctcacgcccaagggaggtgcccctttcgtgctcagctcccttctgcaccaagaccccagcaccaaccagacctggctcctggtcaccagccccagaaccaagaggacaccagggcccctccatcgatgttcccttgtccaggatgaaatcctttgccatcctgtagagcatgtccccatccccaaggggaggcaccggggagtgaccgttgtccggagccaccacggtgttttgatatgcattcaagtgctggtccggcggcctcacagcctcagctcagaactcacaggcacctgtagcctcctgggccctgacctccgtccccaggctcaggccaacttcttcgaccttgaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggttacgctgtggccgtgctgcacaagacctgcagcctctcctacatcgcgggggctccacggtacaaacatcatggggccgtgtttgagctccagaaggagggcagagaggccagcttcctgccagtgctggagggagagcagatggggtcctattttggctctgagctgtgccctgtggacattgacatggatggaagcacggacttcttgctggtggctgctccattttaccacgttcatggagaagaaggcagagtctacgtgtaccgtctcagcgagcaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgacggccttgccgacatcaccgtgggcactctgggccaggcggttgtgttccgctcccggcctgtggttcgcctgaaggtctccatggccttcacccccagcgcactgcccatcggcttcaacggcgtcgtgaatgtccgtttatgttttgaaatcagctctgtaaccacagcctctgagtcaggcctccgcgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagagctctgtgaggaggactgcttctccaatgccagtgtcaaagtcagctaccagctccagacccctgagggacagacggaccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaagcctccctctccaaacattcagtgtgatgaccctcagccggttgcttctgtcctgatcatgaactgcaggattggtcaccccgtcctcaagaggtcatctgctcatgtttcagtcgtttggcagctagaggagaatgcctttccaaacaggacagcagacatcactgtgactgtcaccaattccaatgaaagacggtctttggccaacgagacccacacccttcaattcaggcatggcttcgttgcagttctgtccaaaccatccataatgtacgtgaacacaggccaggggctttctcaccacaaagaattcctcttccatgtacatggggagaacctctttggagcagaataccagttgcaaatttgcgtcccaaccaaattacgaggtctccaggttgtagcagtgaagaagctgacgaggactcaggcctccacggtgtgcacctggagtcaggagcgcgcttgtgcgtacagttcggttcagcatgtggaagaatggcattcagtgagctgtgtcatcgcttcagataaagaaaatgtcaccgtggctgcagagatctcctgggatcactctgaggagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgcagtaaaaaaaaaaaaaaaaaa

SEQ ID NO: 38 - DNA, 4682 bp, Homo sapiens
ggcacgagggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaaaaaaaaaaaaaa

SEQ ID NO: 39 - DNA, 3645 bp, Homo sapiens
tggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacactccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcctccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggct

SEQ ID NO: 40 - DNA, 4355 bp, Homo sapiens
ctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttacccc

SEQ ID NO: 41 - DNA, 3275 bp, Homo sapiens
gcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcggagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctccc

SEQ ID NO: 42 - DNA, 4149 bp, Homo sapiens
atgctgacaatcttcttccttcccctggccacctctctgcccacttgcttcctcagtaccttggtccagctcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcagctcaaaccccctcagcctgttggcttctgttcaccagctgcaagggtttacatacacggccaccgccatccaaaatgtcgtgcaccgattgttccatgcctcatatggggcccgtagggatgccgccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacagcgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgccgatgctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccactccccattaccctcaggacaatgtctgaactctccagcttcgcgtgagaagtccccttccatcccagagggtgggcttcagggcgcacagcatgagaggctctgtgcccccatcaccctcgtttccagtgaattagtgtcatgtcagcatcagctcagggcttcatcgtggggctctcagttccgatttcccaggctgaattgggagtgagatgcctgcatgctgggttctgcacagctggcctcccgcgttgggcaacattgctggctggaagggaggagcgccctctagggagggacatggccccggtgcggctgcagctcacccagccccaggggcagaagagacccaaccacttctattttttgaggctatgaatatagtacctgaaaaaatgccaagacatgattatttttttaaaaagcgtactttaaatgtttgtgttaataaattaaaacatgcacaaaaagatgcatctaccgctcttgggaaatatgtcaaaggtctaaaaataaaaaagccttctgtgaaaaaaaaaaaaaaaaa

SEQ ID NO: 43 - protein, 798 aa, Homo sapiens; identical to SEQ ID NO: 4

SEQ ID NO: 44 - protein, 769 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 45 - protein, 788 aa, Homo sapiens; identical to SEQ ID NO: 5

SEQ ID NO: 46 - protein, 1822 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPTAPRTTAARAGRAAAVPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 47 - protein, 796 aa, Homo sapiens
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYAAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKSYNGTVD

SEQ ID NO: 48 - protein, 788 aa, Homo sapiens
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 49 - protein, 798 aa, Homo sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 50 - protein, 769 aa, Homo sapiens; identical to SEQ ID NO: 6

SEQ ID NO: 51 - DNA, 3879 bp, Homo sapiens
atcagacgcgcagaggaggcggggccgcggctggtttcctgccggggggcggctctgggccgccgagtcccctcctcccgcccctgaggaggaggagccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcaaaaaaaaaa

SEQ ID NO: 52 - DNA, 2780 bp, Homo sapiens
cgttgctgtcgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcag

SEQ ID NO: 53 - DNA, 2637 bp, Homo sapiens
aacacgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcccaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgttcatgtgtgtgtgttgtgtgtgggagtgtgtaatttaaaattgtgatgtgtcctgataagctgag

SEQ ID NO: 54 - DNA, 5994 bp, Homo sapiens
gcgctgcccgcctcgtccccaccccccaaccccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctgtgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggcgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcccccacggccccccggacgacggcggcgcgggcgggaagggcggcagccgtgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaaaaaaaaaaaaaaaaaaaaaaaaaaaaaaaaaaaaaaaaaaaaaaaaaaaaaaaaaaaaaaaaaaaaaaaaaaaa

SEQ ID NO: 55 - DNA, 3110 bp, Homo sapiens
cgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacgcggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaaatcctacaatggcactgtggactgatgtttccttctccgaggggctggagcggggatctgatgaaaaggatcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtgagtttcctctcctgtccgtgtttgtttagtacttttataatgaaaagaaacaagattgtttgggattggaagtaaagattaaaaccaaaagaatttgtgtttgtctgataaaaaaaaaaaaaaa

SEQ ID NO: 56 - DNA, 2401 bp, Homo sapiens
aacagcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatccccttttgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataacgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgca

SEQ ID NO: 57 - DNA, 2742 bp, Homo sapiens
agcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccactgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcag

SEQ ID NO: 58 - DNA, 3789 bp, Homo sapiens
cccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtaccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccgggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcgcccgcgggccccgaggtcgcccgggaggccgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctacgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaa

SEQ ID NO: 59 - protein, 4 aa, Artificial Sequence
  Description of Artificial Sequence: Synthetic peptide
SGCP

SEQ ID NO: 60 - protein, 4 aa, Artificial Sequence
  Description of Artificial Sequence: Synthetic peptide
SCGP

SEQ ID NO: 61 - protein, 4 aa, Artificial Sequence
  Description of Artificial Sequence: Synthetic peptide
GCGP

SEQ ID NO: 62 - protein, 4 aa, Artificial Sequence
  Description of Artificial Sequence: Synthetic peptide
SGCG

SEQ ID NO: 63 - protein, 10 aa, Homo sapiens
DRGSDGKLQE

SEQ ID NO: 64 - protein, 4 aa, Artificial Sequence
  Description of Artificial Sequence: Synthetic peptide
GQGC

SEQ ID NO: 65 - protein, 9 aa, Homo sapiens
DRGSDGKLQ

SEQ ID NO: 66 - protein, 8 aa, Artificial Sequence
  Description of Artificial Sequence: Synthetic peptide
  MOD_RES (1)..(1): Any amino acid
  MOD_RES (6)..(7): Any amino acid
XRGDLXXL

SEQ ID NO: 67 - protein, 8 aa, Artificial Sequence
  Description of Artificial Sequence: Synthetic peptide
  MOD_RES (1)..(1): Any amino acid
  MOD_RES (6)..(7): Any amino acid
XRGDLXXI

SEQ ID NO: 68 - protein, 8 aa, Artificial Sequence
  Description of Artificial Sequence: Synthetic peptide
GRGDLGRL

SEQ ID NO: 69 - protein, 8 aa, Artificial Sequence
  Description of Artificial Sequence: Synthetic peptide
GRGDLGRI

SEQ ID NO: 70 - protein, 4 aa, Homo sapiens
SGDQ

SEQ ID NO: 71 - protein, 4 aa, Homo sapiens
RGDL

SEQ ID NO: 72 - protein, 6 aa, Homo sapiens
GRGDSP

SEQ ID NO: 73 - protein, 5 aa, Homo sapiens
LGRLK

SEQ ID NO: 74 - protein, 5 aa, Homo sapiens
DLSAS

SEQ ID NO: 75 - protein, 9 aa, Homo sapiens
GRGDLGRLK

SEQ ID NO: 76 - protein, 9 aa, Artificial Sequence
  Description of Artificial Sequence: Synthetic peptide
  MOD_RES (2)..(2): Leu, Val or Phe
  MOD_RES (4)..(4): Any amino acid
  MOD_RES (7)..(7): Any amino acid
  MOD_RES (8)..(9): Asp or Asn
DXSXSMXXX

SEQ ID NO: 77 - protein, 9 aa, Artificial Sequence
  Description of Artificial Sequence: Synthetic peptide
  MOD_RES (1)..(1): Val or Ile
  MOD_RES (3)..(3): Any amino acid
  MOD_RES (5)..(5): Any amino acid
  MOD_RES (7)..(7): Ala, Ser or Thr
XSXNXDXPE

SEQ ID NO: 78 - protein, 11 aa, Homo sapiens
HGRGDLGRLKK

SEQ ID NO: 79 - protein, 8 aa, Artificial Sequence
  Description of Artificial Sequence: Synthetic peptide
  MOD_RES (1)..(1): Any amino acid
  MOD_RES (6)..(7): Any amino acid
  MOD_RES (8)..(8): Leu or Ile
XRGDLXXX

SEQ ID NO: 80 - protein, 9 aa, Homo sapiens
RRGDLATIH

SEQ ID NO: 81 - protein, 9 aa, Homo sapiens
TSGDQKTIK

SEQ ID NO: 82 - protein, 9 aa, Homo sapiens
DLSASMDDD

SEQ ID NO: 83 - protein, 21 aa, Homo sapiens
VKTTPEEIANPCSSIPYFCLP

SEQ ID NO: 84 - protein, 9 aa, Homo sapiens
ISANIDTPE

SEQ ID NO: 85 - protein, 9 aa, Homo sapiens
DVSASMHNN

SEQ ID NO: 86 - protein, 21 aa, Homo sapiens
ISIHPERIHNQCSDYNLDCMP

SEQ ID NO: 87 - protein, 9 aa, Homo sapiens
ISGNIDTPE

SEQ ID NO: 88 - protein, 9 aa, Homo sapiens
DLSYSMKDD

SEQ ID NO: 89 - protein, 22 aa, Homo sapiens
MYISPPEALENPCYDMKTTCLP

SEQ ID NO: 90 - protein, 9 aa, Homo sapiens
VSRNRDAPE

SEQ ID NO: 91 - protein, 9 aa, Homo sapiens
DLSLSMKDD

SEQ ID NO: 92 - protein, 23 aa, Homo sapiens
SYTAPRYQTNPCIGYKLFPNCVP

SEQ ID NO: 93 - protein, 9 aa, Homo sapiens
VSRNRDAPE

SEQ ID NO: 94 - protein, 9 aa, Homo sapiens
DFSNSMSDD

SEQ ID NO: 95 - protein, 17 aa, Homo sapiens
TDMRPEKLKEPWPNSDP

SEQ ID NO: 96 - protein, 9 aa, Homo sapiens
ISGNLDAPE

SEQ ID NO: 97 - protein, 9 aa, Homo sapiens
DLSYSMKDD

SEQ ID NO: 98 - protein, 20 aa, Homo sapiens
ISTTPAKLRNPCTSEQNCTT

SEQ ID NO: 99 - protein, 9 aa, Homo sapiens
ISGNLDSPE

SEQ ID NO: 100 - protein, 9 aa, Homo sapiens
DLSYSMLDD

SEQ ID NO: 101 - protein, 21 aa, Homo sapiens
VNTHPDKLRNPCPNKEKECQP

SEQ ID NO: 102 - protein, 9 aa, Homo sapiens
ISGNLDAPE

SEQ ID NO: 103 - protein, 9 aa, Homo sapiens
DLSYSMKDD

SEQ ID NO: 104 - protein, 21 aa, Homo sapiens
VSTVPSKLRHPCPTRLERCQS

SEQ ID NO: 105 - protein, 9 aa, Homo sapiens
VSGNLDSPE

SEQ ID NO: 106 - protein, 11 aa, Homo sapiens
GRRGDLATIHG

SEQ ID NO: 107 - protein, 11 aa, Homo sapiens
YTSGDQKTIKS

SEQ ID NO: 108 - protein, 11 aa, Foot-and-mouth disease virus
NLRGDLQVLAQ

SEQ ID NO: 109 - protein, 10 aa, Homo sapiens
HGRGDLGRLK

SEQ ID NO: 110 - protein, 9 aa, Homo sapiens
HGRGDLGRL

SEQ ID NO: 111 - protein, 8 aa, Homo sapiens
HGRGDLGR

SEQ ID NO: 112 - protein, 7 aa, Homo sapiens
HGRGDLG

SEQ ID NO: 113 - protein, 6 aa, Homo sapiens
HGRGDL

SEQ ID NO: 114 - protein, 5 aa, Homo sapiens
HGRGD

SEQ ID NO: 115 - protein, 594 aa, Homo sapiens
FNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSCPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILL

SEQ ID NO: 116 - protein, 6 aa, Homo sapiens
GCALGG

SEQ ID NO: 117 - protein, 15 aa, Homo sapiens
TCEDCLLIGPQCAWC

SEQ ID NO: 118 - protein, 400 aa, Homo sapiens
RCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVCPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQ

SEQ ID NO: 119 - protein, 22 aa, Homo sapiens
VNSSKCHNGNGSFQCGVCACHP

SEQ ID NO: 120 - protein, 5 aa, Homo sapiens
GPRCE

SEQ ID NO: 121 - protein, 10 aa, Homo sapiens
GRGDLGRLKK

SEQ ID NO: 122 - protein, 28 aa, Homo sapiens
FNLDVDSPAEYSGPEGSYFGFAVDFFVP

SEQ ID NO: 123 - protein, 472 aa, Homo sapiens
SRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSCPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLK

SEQ ID NO: 124 - protein, 89 aa, Homo sapiens
GAIRRALFLYSRSPSHSKNMTISRGGLMQCEELIAYLRDESEFRDKLTPITIFMEYRLDYRTAADTTGLQPILNQFTPANISRQAHILL

SEQ ID NO: 125 - protein, 27 aa, Homo sapiens
GCALGGAETCEDCLLIGPQCAWCATAN

SEQ ID NO: 126 - protein, 402 aa, Homo sapiens
ERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVCPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQK

SEQ ID NO: 127 - protein, 22 aa, Homo sapiens
VEVNSSKCHNGNGSFQCGVCAC

SEQ ID NO: 128 - protein, 4 aa, Homo sapiens
PRCE

SEQ ID NO: 129 - protein, 596 aa, Homo sapiens
FNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSGCPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLA

SEQ ID NO: 130 - protein, 376 aa, Homo sapiens
VSEARVLEDRPLSDKGSGDAAQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVCPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDC

SEQ ID NO: 131 - protein, 605 aa, Artificial Sequence
  Description of Artificial Sequence: Synthetic polypeptide
FNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSGCPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDTGGLEVLFQ

SEQ ID NO: 132 - protein, 6 aa, Artificial Sequence
  Description of Artificial Sequence: Synthetic 6xHis tag
HHHHHH

SEQ ID NO: 133 - protein, 254 aa, Artificial Sequence
  Description of Artificial Sequence: Synthetic polypeptide
QTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVCPNDGLCHLDSKNEYSMSTVLEYPTIGQLIDKLVQNNVLLIFAVTQEQVHLYENYAKLIPGATVGLLQKDSGNILQLIISAYEELRSEHHHHHH

SEQ ID NO: 134 - protein, 387 aa, Artificial Sequence
  Description of Artificial Sequence: Synthetic polypeptide
SKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSSRGLQTLFQ

SEQ ID NO: 135 - protein, 483 aa, Artificial Sequence
  Description of Artificial Sequence: Synthetic polypeptide
HVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVCPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCESRGLQTLFQ

SEQ ID NO: 136 - protein, 481 aa, Artificial Sequence
  Description of Artificial Sequence: Synthetic polypeptide
GPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCESRGLQTLFQ

SEQ ID NO: 137 - protein, 465 aa, Artificial Sequence
  Description of Artificial Sequence: Synthetic polypeptide
EDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKSRGLQTLFQ

What is claimed is:

1. A modified integrin $\alpha_v$ headpiece polypeptide comprising an amino acid sequence of SEQ ID NO: 1 with at least one Cys residue introduced thereto by one or more of the following modifications (a)-(e):
   a. substitution of amino acid residues 399-401 with one of the following: (i) Ser-Cys-Pro; (ii) Gly-Cys-Pro; (iii) Ser-Cys-Gly; (iv) Gly-Cys-Gly; (v) Ser-Gly-Cys-Pro (SEQ ID NO: 59); (vi) Ser-Cys-Gly-Pro (SEQ ID NO: 60); (vii) Gly-Cys-Gly-Pro (SEQ ID NO: 61); and (viii) Ser-Gly-Cys-Gly (SEQ ID NO: 62);
   b. substitution of amino acid residues 310-311 (Gln-Glu) with Gly-Cys;
   c. substitution of amino acid residues 299 (Leu) and 310 (Gln) with Cys and Gly, respectively;
   d. substitution of amino acid residues 302-311 (Asp-Arg-Gly-Ser-Asp-Gly-Lys-Leu-Gln-Glu) (SEQ ID NO: 63) with Gly-Gln-Gly-Cys (SEQ ID NO: 64); and/or
   e. substitution of amino acid residue 299 (Leu) to Cys and substitution of amino acid residues 302-310 (Asp-Arg-Gly-Ser-Asp-Gly-Lys-Leu-Gln) (SEQ ID NO: 65) with Gly-Gln-Gly.

2. A modified integrin $\beta_6$ headpiece polypeptide comprising a βI domain of integrin $\beta_6$ subunit with at least one Cys residue introduced thereto by one or more of the following modifications (a)-(b), the βI domain is defined from residues DYP to residues ELR as shown in an amino acid sequence of SEQ ID NO: 2:
   a. substitution of amino acid residue 294 (Thr) with Cys; and
   b. substitution of amino acid residue 296 (Gly) with Cys.

3. A modified integrin $\beta_3$ headpiece polypeptide comprising amino acid residues 27 to 498 of SEQ ID NO: 5 with at least one Cys residue introduced thereto by substitution of amino acid residue 293 (Gln) with Cys.

4. A modified integrin $\beta_8$ headpiece polypeptide comprising amino acid residues 43 to 498 of SEQ ID NO: 6 with at least one Cys residue introduced thereto by substitution of amino acid residue 301 (Val) with Cys.

5. A modified integrin polypeptide dimer comprising the modified integrin $\alpha_v$ headpiece polypeptide of claim 1 and at least one domain of an integrin β polypeptide selected from the group consisting of a PSI domain, hybrid domain, βI domain, and an EGF-1 domain, wherein the modified integrin $\alpha_v$ headpiece polypeptide and said at least one domain of the integrin β polypeptide are covalently linked by at least one disulfide bond.

6. The modified integrin polypeptide dimer of claim 5, wherein the integrin β polypeptide is selected from the group consisting of $\beta_1$, $\beta_2$, $\beta_3$, $\beta_4$, $\beta_5$, $\beta_6$, $\beta_7$, and $\beta_8$.

7. A modified integrin polypeptide dimer comprising an integrin α polypeptide and the modified integrin $\beta_6$ headpiece polypeptide of claim 2, wherein the integrin α polypeptide and the modified integrin $\beta_6$ headpiece polypeptide are covalently linked by at least one disulfide bond.

8. A modified integrin polypeptide dimer comprising an integrin α polypeptide and the modified integrin $\beta_3$ headpiece polypeptide of claim 3, wherein the integrin α polypeptide and the modified integrin $\beta_3$ headpiece polypeptide are covalently linked by at least one disulfide bond.

9. A modified integrin polypeptide dimer comprising an integrin α polypeptide and the modified integrin $\beta_8$ headpiece polypeptide of claim 4, wherein the integrin α polypeptide and the modified integrin $\beta_8$ headpiece polypeptide are covalently linked by at least one disulfide bond.

10. The modified integrin polypeptide dimer of claim 7, wherein the integrin α polypeptide is selected from the group consisting of $\alpha_1$, $\alpha_2$, $\alpha_3$, $\alpha_4$, $\alpha_5$, $\alpha_6$, $\alpha_7$, $\alpha_8$, $\alpha_9$, $\alpha_{10}$, $\alpha_{11}$, $\alpha_D$, $\alpha_E$, $\alpha_L$, $\alpha_M$, $\alpha_v$, $\alpha_{2B}$, and $\alpha_X$.

11. A modified integrin $\alpha_v$ headpiece polypeptide comprising an amino acid sequence of SEQ ID NO: 131.

12. A modified integrin $\beta_6$ headpiece polypeptide comprising an amino acid sequence of SEQ ID NO: 133 (with or without a His$_6$ tag (SEQ ID NO: 132)) or SEQ ID NO: 135.

13. A modified integrin $\beta_3$ headpiece polypeptide comprising an amino acid sequence of SEQ ID NO: 136.

14. A modified integrin $\beta_8$ headpiece polypeptide comprising an amino acid sequence of SEQ ID NO: 134 or SEQ ID NO: 137.

15. A modified integrin polypeptide dimer comprising (i) the modified integrin $\alpha_v$ headpiece polypeptide of claim 11, and (ii) the modified integrin $\beta_6$ headpiece polypeptide of claim 12.

16. A modified integrin polypeptide dimer comprising (i) the modified integrin $\alpha_v$ headpiece polypeptide of claim 11, and (ii) the modified integrin $\beta_3$ headpiece polypeptide of claim 13.

* * * * *

UNITED STATES PATENT AND TRADEMARK OFFICE
CERTIFICATE OF CORRECTION

PATENT NO. : 10,273,283 B2
APPLICATION NO. : 15/424260
DATED : April 30, 2019
INVENTOR(S) : Timothy Alan Springer, Xianchi Dong and Chafen Lu It is certified that error appears in the above-identified patent and that said Letters Patent is hereby corrected as shown below:

In the Specification

At Column 1, Line 62, please replace "acv" with -- $\alpha_v$ --

At Column 6, Line 33, please replace "(Gin)" with -- (Gln) --

At Column 8, Line 19, please replace "(Gin)" with -- (Gln) --

At Column 60, Line 25, please replace "$\alpha\alpha_v\beta_3$" with -- $\alpha_v\beta_3$ -

At Column 84, Line 30, please replace "cav" with -- $\alpha_v$ --

Signed and Sealed this
Third Day of December, 2019

Andrei Iancu
*Director of the United States Patent and Trademark Office*